United States Patent 12,247,232 (METHODS AND COMPOSITIONS FOR INHIBITING ADAM 9 BIOLOGICAL ACTIVITIES) - sequence listing, part 5

SEQ ID NO: 35204 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKAGVSNKDIEKETAKDASSEPPSMTQLLRR

SEQ ID NO: 35205 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKAGVSNKDIEKETAKDASAEPPSMTQLLRR

SEQ ID NO: 35206 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKAGVSNKDIEKETAKDAAGEPPSMTQLLRR

SEQ ID NO: 35207 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKAGVSNKDIEKETAKDAASEPPSMTQLLRR

SEQ ID NO: 35208 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKAGVSNKDIEKETAKDAAAEPPSMTQLLRR

SEQ ID NO: 35209 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKGGVSNKDIEKETAKDGGGEPPSMTQLLRR

SEQ ID NO: 35210 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKGGVSNKDIEKETAKDGGSEPPSMTQLLRR

SEQ ID NO: 35211 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKGGVSNKDIEKETAKDGGAEPPSMTQLLRR

SEQ ID NO: 35212 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKGGVSNKDIEKETAKDGSGEPPSMTQLLRR

SEQ ID NO: 35213 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKGGVSNKDIEKETAKDGSSEPPSMTQLLRR

SEQ ID NO: 35214 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKGGVSNKDIEKETAKDGSAEPPSMTQLLRR

SEQ ID NO: 35215 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKGGVSNKDIEKETAKDGAGEPPSMTQLLRR

SEQ ID NO: 35216 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKGGVSNKDIEKETAKDGASEPPSMTQLLRR

SEQ ID NO: 35217 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKGGVSNKDIEKETAKDGAAEPPSMTQLLRR

SEQ ID NO: 35218 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKGGVSNKDIEKETAKDSGGEPPSMTQLLRR

SEQ ID NO: 35219 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKGGVSNKDIEKETAKDSGSEPPSMTQLLRR

SEQ ID NO: 35220 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKGGVSNKDIEKETAKDSGAEPPSMTQLLRR

SEQ ID NO: 35221 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKGGVSNKDIEKETAKDSSGEPPSMTQLLRR

SEQ ID NO: 35222 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKGGVSNKDIEKETAKDSSSEPPSMTQLLRR

SEQ ID NO: 35223 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKGGVSNKDIEKETAKDSSAEPPSMTQLLRR

SEQ ID NO: 35224 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKGGVSNKDIEKETAKDSAGEPPSMTQLLRR

SEQ ID NO: 35225 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKGGVSNKDIEKETAKDSASEPPSMTQLLRR

SEQ ID NO: 35226 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKGGVSNKDIEKETAKDSAAEPPSMTQLLRR

SEQ ID NO: 35227 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKGGVSNKDIEKETAKDAGGEPPSMTQLLRR

SEQ ID NO: 35228 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKGGVSNKDIEKETAKDAGSEPPSMTQLLRR

SEQ ID NO: 35229 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKGGVSNKDIEKETAKDAGAEPPSMTQLLRR

SEQ ID NO: 35230 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKGGVSNKDIEKETAKDASGEPPSMTQLLRR

SEQ ID NO: 35231 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKGGVSNKDIEKETAKDASSEPPSMTQLLRR

SEQ ID NO: 35232 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKGGVSNKDIEKETAKDASAEPPSMTQLLRR

SEQ ID NO: 35233 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKGGVSNKDIEKETAKDAAGEPPSMTQLLRR

SEQ ID NO: 35234 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKGGVSNKDIEKETAKDAASEPPSMTQLLRR

SEQ ID NO: 35235 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKGGVSNKDIEKETAKDAAAEPPSMTQLLRR

SEQ ID NO: 35236 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKDGVSNKDIEKETAKDGGGEPPSMTQLLRR

SEQ ID NO: 35237 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKDGVSNKDIEKETAKDGGSEPPSMTQLLRR

SEQ ID NO: 35238 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKDGVSNKDIEKETAKDGGAEPPSMTQLLRR

SEQ ID NO: 35239 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKDGVSNKDIEKETAKDGSGEPPSMTQLLRR

SEQ ID NO: 35240 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKDGVSNKDIEKETAKDGSSEPPSMTQLLRR

SEQ ID NO: 35241 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKDGVSNKDIEKETAKDGSAEPPSMTQLLRR

SEQ ID NO: 35242 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKDGVSNKDIEKETAKDGAGEPPSMTQLLRR

SEQ ID NO: 35243 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKDGVSNKDIEKETAKDGASEPPSMTQLLRR

SEQ ID NO: 35244 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKDGVSNKDIEKETAKDGAAEPPSMTQLLRR

SEQ ID NO: 35245 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKDGVSNKDIEKETAKDSGGEPPSMTQLLRR

SEQ ID NO: 35246 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKDGVSNKDIEKETAKDSGSEPPSMTQLLRR

SEQ ID NO: 35247 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKDGVSNKDIEKETAKDSGAEPPSMTQLLRR

SEQ ID NO: 35248 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKDGVSNKDIEKETAKDSSGEPPSMTQLLRR

SEQ ID NO: 35249 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKDGVSNKDIEKETAKDSSSEPPSMTQLLRR

SEQ ID NO: 35250 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKDGVSNKDIEKETAKDSSAEPPSMTQLLRR

SEQ ID NO: 35251 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKDGVSNKDIEKETAKDSAGEPPSMTQLLRR

SEQ ID NO: 35252 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKDGVSNKDIEKETAKDSASEPPSMTQLLRR

SEQ ID NO: 35253 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKDGVSNKDIEKETAKDSAAEPPSMTQLLRR

SEQ ID NO: 35254 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKDGVSNKDIEKETAKDAGGEPPSMTQLLRR

SEQ ID NO: 35255 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKDGVSNKDIEKETAKDAGSEPPSMTQLLRR

SEQ ID NO: 35256 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKDGVSNKDIEKETAKDAGAEPPSMTQLLRR

SEQ ID NO: 35257 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKDGVSNKDIEKETAKDASGEPPSMTQLLRR

SEQ ID NO: 35258 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKDGVSNKDIEKETAKDASSEPPSMTQLLRR

SEQ ID NO: 35259 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKDGVSNKDIEKETAKDASAEPPSMTQLLRR

SEQ ID NO: 35260 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKDGVSNKDIEKETAKDAAGEPPSMTQLLRR

SEQ ID NO: 35261 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKDGVSNKDIEKETAKDAASEPPSMTQLLRR

SEQ ID NO: 35262 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKDGVSNKDIEKETAKDAAAEPPSMTQLLRR

SEQ ID NO: 35263 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKHGVSNKDIEKETAKDGGGEPPSMTQLLRR

SEQ ID NO: 35264 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKHGVSNKDIEKETAKDGGSEPPSMTQLLRR

SEQ ID NO: 35265 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKHGVSNKDIEKETAKDGGAEPPSMTQLLRR

SEQ ID NO: 35266 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKHGVSNKDIEKETAKDGSGEPPSMTQLLRR

SEQ ID NO: 35267 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKHGVSNKDIEKETAKDGSSEPPSMTQLLRR

SEQ ID NO: 35268 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKHGVSNKDIEKETAKDGSAEPPSMTQLLRR

SEQ ID NO: 35269 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKHGVSNKDIEKETAKDGAGEPPSMTQLLRR

SEQ ID NO: 35270 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKHGVSNKDIEKETAKDGASEPPSMTQLLRR

SEQ ID NO: 35271 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKHGVSNKDIEKETAKDGAAEPPSMTQLLRR

SEQ ID NO: 35272 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKHGVSNKDIEKETAKDSGGEPPSMTQLLRR

SEQ ID NO: 35273 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKHGVSNKDIEKETAKDSGSEPPSMTQLLRR

SEQ ID NO: 35274 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKHGVSNKDIEKETAKDSGAEPPSMTQLLRR

SEQ ID NO: 35275 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKHGVSNKDIEKETAKDSSGEPPSMTQLLRR

SEQ ID NO: 35276 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKHGVSNKDIEKETAKDSSSEPPSMTQLLRR

SEQ ID NO: 35277 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKHGVSNKDIEKETAKDSSAEPPSMTQLLRR

SEQ ID NO: 35278 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKHGVSNKDIEKETAKDSAGEPPSMTQLLRR

SEQ ID NO: 35279 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKHGVSNKDIEKETAKDSASEPPSMTQLLRR

SEQ ID NO: 35280 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKHGVSNKDIEKETAKDSAAEPPSMTQLLRR

SEQ ID NO: 35281 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKHGVSNKDIEKETAKDAGGEPPSMTQLLRR

SEQ ID NO: 35282 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKHGVSNKDIEKETAKDAGSEPPSMTQLLRR

SEQ ID NO: 35283 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKHGVSNKDIEKETAKDAGAEPPSMTQLLRR

SEQ ID NO: 35284 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKHGVSNKDIEKETAKDASGEPPSMTQLLRR

SEQ ID NO: 35285 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKHGVSNKDIEKETAKDASSEPPSMTQLLRR

SEQ ID NO: 35286 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKHGVSNKDIEKETAKDASAEPPSMTQLLRR

SEQ ID NO: 35287 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKHGVSNKDIEKETAKDAAGEPPSMTQLLRR

SEQ ID NO: 35288 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKHGVSNKDIEKETAKDAASEPPSMTQLLRR

SEQ ID NO: 35289 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKHGVSNKDIEKETAKDAAAEPPSMTQLLRR

SEQ ID NO: 35290 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKYGVSNKDIEKETAKDGGGEPPSMTQLLRR

SEQ ID NO: 35291 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKYGVSNKDIEKETAKDGGSEPPSMTQLLRR

SEQ ID NO: 35292 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKYGVSNKDIEKETAKDGGAEPPSMTQLLRR

SEQ ID NO: 35293 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKYGVSNKDIEKETAKDGSGEPPSMTQLLRR

SEQ ID NO: 35294 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKYGVSNKDIEKETAKDGSSEPPSMTQLLRR

SEQ ID NO: 35295 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKYGVSNKDIEKETAKDGSAEPPSMTQLLRR

SEQ ID NO: 35296 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKYGVSNKDIEKETAKDGAGEPPSMTQLLRR

SEQ ID NO: 35297 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKYGVSNKDIEKETAKDGASEPPSMTQLLRR

SEQ ID NO: 35298 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKYGVSNKDIEKETAKDGAAEPPSMTQLLRR

SEQ ID NO: 35299 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKYGVSNKDIEKETAKDSGGEPPSMTQLLRR

SEQ ID NO: 35300 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKYGVSNKDIEKETAKDSGSEPPSMTQLLRR

SEQ ID NO: 35301 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKYGVSNKDIEKETAKDSGAEPPSMTQLLRR

SEQ ID NO: 35302 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKYGVSNKDIEKETAKDSSGEPPSMTQLLRR

SEQ ID NO: 35303 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKYGVSNKDIEKETAKDSSSEPPSMTQLLRR

SEQ ID NO: 35304 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKYGVSNKDIEKETAKDSSAEPPSMTQLLRR

SEQ ID NO: 35305 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKYGVSNKDIEKETAKDSAGEPPSMTQLLRR

SEQ ID NO: 35306 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKYGVSNKDIEKETAKDSASEPPSMTQLLRR

SEQ ID NO: 35307 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKYGVSNKDIEKETAKDSAAEPPSMTQLLRR

SEQ ID NO: 35308 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKYGVSNKDIEKETAKDAGGEPPSMTQLLRR

SEQ ID NO: 35309 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKYGVSNKDIEKETAKDAGSEPPSMTQLLRR

SEQ ID NO: 35310 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKYGVSNKDIEKETAKDAGAEPPSMTQLLRR

SEQ ID NO: 35311 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKYGVSNKDIEKETAKDASGEPPSMTQLLRR

SEQ ID NO: 35312 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKYGVSNKDIEKETAKDASSEPPSMTQLLRR

SEQ ID NO: 35313 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKYGVSNKDIEKETAKDASAEPPSMTQLLRR

SEQ ID NO: 35314 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKYGVSNKDIEKETAKDAAGEPPSMTQLLRR

SEQ ID NO: 35315 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKYGVSNKDIEKETAKDAASEPPSMTQLLRR

SEQ ID NO: 35316 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKYGVSNKDIEKETAKDAAAEPPSMTQLLRR

SEQ ID NO: 35317 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKKGVSNKDIEKETAKDGGGEPPSMTQLLRR

SEQ ID NO: 35318 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKKGVSNKDIEKETAKDGGSEPPSMTQLLRR

SEQ ID NO: 35319 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKKGVSNKDIEKETAKDGGAEPPSMTQLLRR

SEQ ID NO: 35320 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKKGVSNKDIEKETAKDGSGEPPSMTQLLRR

SEQ ID NO: 35321 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKKGVSNKDIEKETAKDGSSEPPSMTQLLRR

SEQ ID NO: 35322 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKKGVSNKDIEKETAKDGSAEPPSMTQLLRR

SEQ ID NO: 35323 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKKGVSNKDIEKETAKDGAGEPPSMTQLLRR

SEQ ID NO: 35324 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKKGVSNKDIEKETAKDGASEPPSMTQLLRR

SEQ ID NO: 35325 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKKGVSNKDIEKETAKDGAAEPPSMTQLLRR

SEQ ID NO: 35326 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKKGVSNKDIEKETAKDSGGEPPSMTQLLRR

SEQ ID NO: 35327 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKKGVSNKDIEKETAKDSGSEPPSMTQLLRR

SEQ ID NO: 35328 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKKGVSNKDIEKETAKDSGAEPPSMTQLLRR

SEQ ID NO: 35329 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKKGVSNKDIEKETAKDSSGEPPSMTQLLRR

SEQ ID NO: 35330 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKKGVSNKDIEKETAKDSSSEPPSMTQLLRR

SEQ ID NO: 35331 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKKGVSNKDIEKETAKDSSAEPPSMTQLLRR

SEQ ID NO: 35332 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKKGVSNKDIEKETAKDSAGEPPSMTQLLRR

SEQ ID NO: 35333 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKKGVSNKDIEKETAKDSASEPPSMTQLLRR

SEQ ID NO: 35334 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKKGVSNKDIEKETAKDSAAEPPSMTQLLRR

SEQ ID NO: 35335 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKKGVSNKDIEKETAKDAGGEPPSMTQLLRR

SEQ ID NO: 35336 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKKGVSNKDIEKETAKDAGSEPPSMTQLLRR

SEQ ID NO: 35337 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKKGVSNKDIEKETAKDAGAEPPSMTQLLRR

SEQ ID NO: 35338 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKKGVSNKDIEKETAKDASGEPPSMTQLLRR

SEQ ID NO: 35339 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKKGVSNKDIEKETAKDASSEPPSMTQLLRR

SEQ ID NO: 35340 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKKGVSNKDIEKETAKDASAEPPSMTQLLRR

SEQ ID NO: 35341 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKKGVSNKDIEKETAKDAAGEPPSMTQLLRR

SEQ ID NO: 35342 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKKGVSNKDIEKETAKDAASEPPSMTQLLRR

SEQ ID NO: 35343 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKKGVSNKDIEKETAKDAAAEPPSMTQLLRR

SEQ ID NO: 35344 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKNGVSNKDIEKETAKDGGGEPPSMTQLLRR

SEQ ID NO: 35345 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKNGVSNKDIEKETAKDGGSEPPSMTQLLRR

SEQ ID NO: 35346 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKNGVSNKDIEKETAKDGGAEPPSMTQLLRR

SEQ ID NO: 35347 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKNGVSNKDIEKETAKDGSGEPPSMTQLLRR

SEQ ID NO: 35348 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKNGVSNKDIEKETAKDGSSEPPSMTQLLRR

SEQ ID NO: 35349 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKNGVSNKDIEKETAKDGSAEPPSMTQLLRR

SEQ ID NO: 35350 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKNGVSNKDIEKETAKDGAGEPPSMTQLLRR

SEQ ID NO: 35351 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKNGVSNKDIEKETAKDGASEPPSMTQLLRR

SEQ ID NO: 35352 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKNGVSNKDIEKETAKDGAAEPPSMTQLLRR

SEQ ID NO: 35353 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKNGVSNKDIEKETAKDSGGEPPSMTQLLRR

SEQ ID NO: 35354 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKNGVSNKDIEKETAKDSGSEPPSMTQLLRR

SEQ ID NO: 35355 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKNGVSNKDIEKETAKDSGAEPPSMTQLLRR

SEQ ID NO: 35356 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKNGVSNKDIEKETAKDSSGEPPSMTQLLRR

SEQ ID NO: 35357 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKNGVSNKDIEKETAKDSSSEPPSMTQLLRR

SEQ ID NO: 35358 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKNGVSNKDIEKETAKDSSAEPPSMTQLLRR

SEQ ID NO: 35359 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKNGVSNKDIEKETAKDSAGEPPSMTQLLRR

SEQ ID NO: 35360 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKNGVSNKDIEKETAKDSASEPPSMTQLLRR

SEQ ID NO: 35361 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKNGVSNKDIEKETAKDSAAEPPSMTQLLRR

SEQ ID NO: 35362 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKNGVSNKDIEKETAKDAGGEPPSMTQLLRR

SEQ ID NO: 35363 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKNGVSNKDIEKETAKDAGSEPPSMTQLLRR

SEQ ID NO: 35364 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKNGVSNKDIEKETAKDAGAEPPSMTQLLRR

SEQ ID NO: 35365 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKNGVSNKDIEKETAKDASGEPPSMTQLLRR

SEQ ID NO: 35366 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKNGVSNKDIEKETAKDASSEPPSMTQLLRR

SEQ ID NO: 35367 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKNGVSNKDIEKETAKDASAEPPSMTQLLRR

SEQ ID NO: 35368 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKNGVSNKDIEKETAKDAAGEPPSMTQLLRR

SEQ ID NO: 35369 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKNGVSNKDIEKETAKDAASEPPSMTQLLRR

SEQ ID NO: 35370 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKNGVSNKDIEKETAKDAAAEPPSMTQLLRR

SEQ ID NO: 35371 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKMGVSNKDIEKETAKDGGGEPPSMTQLLRR

SEQ ID NO: 35372 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKMGVSNKDIEKETAKDGGSEPPSMTQLLRR

SEQ ID NO: 35373 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKMGVSNKDIEKETAKDGGAEPPSMTQLLRR

SEQ ID NO: 35374 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKMGVSNKDIEKETAKDGSGEPPSMTQLLRR

SEQ ID NO: 35375 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKMGVSNKDIEKETAKDGSSEPPSMTQLLRR

SEQ ID NO: 35376 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKMGVSNKDIEKETAKDGSAEPPSMTQLLRR

SEQ ID NO: 35377 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKMGVSNKDIEKETAKDGAGEPPSMTQLLRR

SEQ ID NO: 35378 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKMGVSNKDIEKETAKDGASEPPSMTQLLRR

SEQ ID NO: 35379 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKMGVSNKDIEKETAKDGAAEPPSMTQLLRR

SEQ ID NO: 35380 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKMGVSNKDIEKETAKDSGGEPPSMTQLLRR

SEQ ID NO: 35381 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKMGVSNKDIEKETAKDSGSEPPSMTQLLRR

SEQ ID NO: 35382 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKMGVSNKDIEKETAKDSGAEPPSMTQLLRR

SEQ ID NO: 35383 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKMGVSNKDIEKETAKDSSGEPPSMTQLLRR

SEQ ID NO: 35384 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKMGVSNKDIEKETAKDSSSEPPSMTQLLRR

SEQ ID NO: 35385 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKMGVSNKDIEKETAKDSSAEPPSMTQLLRR

SEQ ID NO: 35386 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKMGVSNKDIEKETAKDSAGEPPSMTQLLRR

SEQ ID NO: 35387 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKMGVSNKDIEKETAKDSASEPPSMTQLLRR

SEQ ID NO: 35388 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKMGVSNKDIEKETAKDSAAEPPSMTQLLRR

SEQ ID NO: 35389 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKMGVSNKDIEKETAKDAGGEPPSMTQLLRR

SEQ ID NO: 35390 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKMGVSNKDIEKETAKDAGSEPPSMTQLLRR

SEQ ID NO: 35391 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKMGVSNKDIEKETAKDAGAEPPSMTQLLRR

SEQ ID NO: 35392 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKMGVSNKDIEKETAKDASGEPPSMTQLLRR

SEQ ID NO: 35393 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKMGVSNKDIEKETAKDASSEPPSMTQLLRR

SEQ ID NO: 35394 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKMGVSNKDIEKETAKDASAEPPSMTQLLRR

SEQ ID NO: 35395 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKMGVSNKDIEKETAKDAAGEPPSMTQLLRR

SEQ ID NO: 35396 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKMGVSNKDIEKETAKDAASEPPSMTQLLRR

SEQ ID NO: 35397 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKMGVSNKDIEKETAKDAAAEPPSMTQLLRR

SEQ ID NO: 35398 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKCGVSNKDIEKETAKDGGGEPPSMTQLLRR

SEQ ID NO: 35399 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKCGVSNKDIEKETAKDGGSEPPSMTQLLRR

SEQ ID NO: 35400 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKCGVSNKDIEKETAKDGGAEPPSMTQLLRR

SEQ ID NO: 35401 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKCGVSNKDIEKETAKDGSGEPPSMTQLLRR

SEQ ID NO: 35402 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKCGVSNKDIEKETAKDGSSEPPSMTQLLRR

SEQ ID NO: 35403 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKCGVSNKDIEKETAKDGSAEPPSMTQLLRR

SEQ ID NO: 35404 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKCGVSNKDIEKETAKDGAGEPPSMTQLLRR

SEQ ID NO: 35405 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKCGVSNKDIEKETAKDGASEPPSMTQLLRR

SEQ ID NO: 35406 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKCGVSNKDIEKETAKDGAAEPPSMTQLLRR

SEQ ID NO: 35407 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKCGVSNKDIEKETAKDSGGEPPSMTQLLRR

SEQ ID NO: 35408 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKCGVSNKDIEKETAKDSGSEPPSMTQLLRR

SEQ ID NO: 35409 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKCGVSNKDIEKETAKDSGAEPPSMTQLLRR

SEQ ID NO: 35410 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKCGVSNKDIEKETAKDSSGEPPSMTQLLRR

SEQ ID NO: 35411 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKCGVSNKDIEKETAKDSSSEPPSMTQLLRR

SEQ ID NO: 35412 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKCGVSNKDIEKETAKDSSAEPPSMTQLLRR

SEQ ID NO: 35413 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKCGVSNKDIEKETAKDSAGEPPSMTQLLRR

SEQ ID NO: 35414 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKCGVSNKDIEKETAKDSASEPPSMTQLLRR

SEQ ID NO: 35415 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKCGVSNKDIEKETAKDSAAEPPSMTQLLRR

SEQ ID NO: 35416 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKCGVSNKDIEKETAKDAGGEPPSMTQLLRR

SEQ ID NO: 35417 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKCGVSNKDIEKETAKDAGSEPPSMTQLLRR

SEQ ID NO: 35418 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKCGVSNKDIEKETAKDAGAEPPSMTQLLRR

SEQ ID NO: 35419 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKCGVSNKDIEKETAKDASGEPPSMTQLLRR

SEQ ID NO: 35420 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKCGVSNKDIEKETAKDASSEPPSMTQLLRR

SEQ ID NO: 35421 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKCGVSNKDIEKETAKDASAEPPSMTQLLRR

SEQ ID NO: 35422 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKCGVSNKDIEKETAKDAAGEPPSMTQLLRR

SEQ ID NO: 35423 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKCGVSNKDIEKETAKDAASEPPSMTQLLRR

SEQ ID NO: 35424 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKCGVSNKDIEKETAKDAAAEPPSMTQLLRR

SEQ ID NO: 35425 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKSGVSNKDIEKETAKDGGGEPPSMTQLLRR

SEQ ID NO: 35426 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKSGVSNKDIEKETAKDGGSEPPSMTQLLRR

SEQ ID NO: 35427 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKSGVSNKDIEKETAKDGGAEPPSMTQLLRR

SEQ ID NO: 35428 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKSGVSNKDIEKETAKDGSGEPPSMTQLLRR

SEQ ID NO: 35429 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKSGVSNKDIEKETAKDGSSEPPSMTQLLRR

SEQ ID NO: 35430 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKSGVSNKDIEKETAKDGSAEPPSMTQLLRR

SEQ ID NO: 35431 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKSGVSNKDIEKETAKDGAGEPPSMTQLLRR

SEQ ID NO: 35432 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKSGVSNKDIEKETAKDGASEPPSMTQLLRR

SEQ ID NO: 35433 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKSGVSNKDIEKETAKDGAAEPPSMTQLLRR

SEQ ID NO: 35434 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKSGVSNKDIEKETAKDSGGEPPSMTQLLRR

SEQ ID NO: 35435 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKSGVSNKDIEKETAKDSGSEPPSMTQLLRR

SEQ ID NO: 35436 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKSGVSNKDIEKETAKDSGAEPPSMTQLLRR

SEQ ID NO: 35437 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKSGVSNKDIEKETAKDSSGEPPSMTQLLRR

SEQ ID NO: 35438 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKSGVSNKDIEKETAKDSSSEPPSMTQLLRR

SEQ ID NO: 35439 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKSGVSNKDIEKETAKDSSAEPPSMTQLLRR

SEQ ID NO: 35440 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKSGVSNKDIEKETAKDSAGEPPSMTQLLRR

SEQ ID NO: 35441 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKSGVSNKDIEKETAKDSASEPPSMTQLLRR

SEQ ID NO: 35442 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKSGVSNKDIEKETAKDSAAEPPSMTQLLRR

SEQ ID NO: 35443 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKSGVSNKDIEKETAKDAGGEPPSMTQLLRR

SEQ ID NO: 35444 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKSGVSNKDIEKETAKDAGSEPPSMTQLLRR

SEQ ID NO: 35445 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKSGVSNKDIEKETAKDAGAEPPSMTQLLRR

SEQ ID NO: 35446 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKSGVSNKDIEKETAKDASGEPPSMTQLLRR

SEQ ID NO: 35447 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKSGVSNKDIEKETAKDASSEPPSMTQLLRR

SEQ ID NO: 35448 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKSGVSNKDIEKETAKDASAEPPSMTQLLRR

SEQ ID NO: 35449 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKSGVSNKDIEKETAKDAAGEPPSMTQLLRR

SEQ ID NO: 35450 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKSGVSNKDIEKETAKDAASEPPSMTQLLRR

SEQ ID NO: 35451 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKSGVSNKDIEKETAKDAAAEPPSMTQLLRR

SEQ ID NO: 35452 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKAGVSNKDIEKETAKDGGGEPPSMTQLLRR

SEQ ID NO: 35453 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKAGVSNKDIEKETAKDGGSEPPSMTQLLRR

SEQ ID NO: 35454 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKAGVSNKDIEKETAKDGGAEPPSMTQLLRR

SEQ ID NO: 35455 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKAGVSNKDIEKETAKDGSGEPPSMTQLLRR

SEQ ID NO: 35456 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKAGVSNKDIEKETAKDGSSEPPSMTQLLRR

SEQ ID NO: 35457 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKAGVSNKDIEKETAKDGSAEPPSMTQLLRR

SEQ ID NO: 35458 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKAGVSNKDIEKETAKDGAGEPPSMTQLLRR

SEQ ID NO: 35459 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKAGVSNKDIEKETAKDGASEPPSMTQLLRR

SEQ ID NO: 35460 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKAGVSNKDIEKETAKDGAAEPPSMTQLLRR

SEQ ID NO: 35461 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKAGVSNKDIEKETAKDSGGEPPSMTQLLRR

SEQ ID NO: 35462 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKAGVSNKDIEKETAKDSGSEPPSMTQLLRR

SEQ ID NO: 35463 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKAGVSNKDIEKETAKDSGAEPPSMTQLLRR

SEQ ID NO: 35464 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKAGVSNKDIEKETAKDSSGEPPSMTQLLRR

SEQ ID NO: 35465 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKAGVSNKDIEKETAKDSSSEPPSMTQLLRR

SEQ ID NO: 35466 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKAGVSNKDIEKETAKDSSAEPPSMTQLLRR

SEQ ID NO: 35467 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKAGVSNKDIEKETAKDSAGEPPSMTQLLRR

SEQ ID NO: 35468 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKAGVSNKDIEKETAKDSASEPPSMTQLLRR

SEQ ID NO: 35469 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKAGVSNKDIEKETAKDSAAEPPSMTQLLRR

SEQ ID NO: 35470 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKAGVSNKDIEKETAKDAGGEPPSMTQLLRR

SEQ ID NO: 35471 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKAGVSNKDIEKETAKDAGSEPPSMTQLLRR

SEQ ID NO: 35472 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKAGVSNKDIEKETAKDAGAEPPSMTQLLRR

SEQ ID NO: 35473 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKAGVSNKDIEKETAKDASGEPPSMTQLLRR

SEQ ID NO: 35474 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKAGVSNKDIEKETAKDASSEPPSMTQLLRR

SEQ ID NO: 35475 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKAGVSNKDIEKETAKDASAEPPSMTQLLRR

SEQ ID NO: 35476 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKAGVSNKDIEKETAKDAAGEPPSMTQLLRR

SEQ ID NO: 35477 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKAGVSNKDIEKETAKDAASEPPSMTQLLRR

SEQ ID NO: 35478 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKAGVSNKDIEKETAKDAAAEPPSMTQLLRR

SEQ ID NO: 35479 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKGGVSNKDIEKETAKDGGGEPPSMTQLLRR

SEQ ID NO: 35480 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKGGVSNKDIEKETAKDGGSEPPSMTQLLRR

SEQ ID NO: 35481 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKGGVSNKDIEKETAKDGGAEPPSMTQLLRR

SEQ ID NO: 35482 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKGGVSNKDIEKETAKDGSGEPPSMTQLLRR

SEQ ID NO: 35483 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKGGVSNKDIEKETAKDGSSEPPSMTQLLRR

SEQ ID NO: 35484 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKGGVSNKDIEKETAKDGSAEPPSMTQLLRR

SEQ ID NO: 35485 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKGGVSNKDIEKETAKDGAGEPPSMTQLLRR

SEQ ID NO: 35486 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKGGVSNKDIEKETAKDGASEPPSMTQLLRR

SEQ ID NO: 35487 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKGGVSNKDIEKETAKDGAAEPPSMTQLLRR

SEQ ID NO: 35488 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKGGVSNKDIEKETAKDSGGEPPSMTQLLRR

SEQ ID NO: 35489 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKGGVSNKDIEKETAKDSGSEPPSMTQLLRR

SEQ ID NO: 35490 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKGGVSNKDIEKETAKDSGAEPPSMTQLLRR

SEQ ID NO: 35491 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKGGVSNKDIEKETAKDSSGEPPSMTQLLRR

SEQ ID NO: 35492 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKGGVSNKDIEKETAKDSSSEPPSMTQLLRR

SEQ ID NO: 35493 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKGGVSNKDIEKETAKDSSAEPPSMTQLLRR

SEQ ID NO: 35494 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKGGVSNKDIEKETAKDSAGEPPSMTQLLRR

SEQ ID NO: 35495 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKGGVSNKDIEKETAKDSASEPPSMTQLLRR

SEQ ID NO: 35496 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKGGVSNKDIEKETAKDSAAEPPSMTQLLRR

SEQ ID NO: 35497 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKGGVSNKDIEKETAKDAGGEPPSMTQLLRR

SEQ ID NO: 35498 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKGGVSNKDIEKETAKDAGSEPPSMTQLLRR

SEQ ID NO: 35499 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKGGVSNKDIEKETAKDAGAEPPSMTQLLRR

SEQ ID NO: 35500 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKGGVSNKDIEKETAKDASGEPPSMTQLLRR

SEQ ID NO: 35501 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKGGVSNKDIEKETAKDASSEPPSMTQLLRR

SEQ ID NO: 35502 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKGGVSNKDIEKETAKDASAEPPSMTQLLRR

SEQ ID NO: 35503 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKGGVSNKDIEKETAKDAAGEPPSMTQLLRR

SEQ ID NO: 35504 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKGGVSNKDIEKETAKDAASEPPSMTQLLRR

SEQ ID NO: 35505 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKGGVSNKDIEKETAKDAAAEPPSMTQLLRR

SEQ ID NO: 35506 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKDGVSNKDIEKETAKDGGGEPPSMTQLLRR

SEQ ID NO: 35507 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKDGVSNKDIEKETAKDGGSEPPSMTQLLRR

SEQ ID NO: 35508 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKDGVSNKDIEKETAKDGGAEPPSMTQLLRR

SEQ ID NO: 35509 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKDGVSNKDIEKETAKDGSGEPPSMTQLLRR

SEQ ID NO: 35510 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKDGVSNKDIEKETAKDGSSEPPSMTQLLRR

SEQ ID NO: 35511 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKDGVSNKDIEKETAKDGSAEPPSMTQLLRR

SEQ ID NO: 35512 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKDGVSNKDIEKETAKDGAGEPPSMTQLLRR

SEQ ID NO: 35513 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKDGVSNKDIEKETAKDGASEPPSMTQLLRR

SEQ ID NO: 35514 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKDGVSNKDIEKETAKDGAAEPPSMTQLLRR

SEQ ID NO: 35515 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKDGVSNKDIEKETAKDSGGEPPSMTQLLRR

SEQ ID NO: 35516 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKDGVSNKDIEKETAKDSGSEPPSMTQLLRR

SEQ ID NO: 35517 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKDGVSNKDIEKETAKDSGAEPPSMTQLLRR

SEQ ID NO: 35518 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKDGVSNKDIEKETAKDSSGEPPSMTQLLRR

SEQ ID NO: 35519 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKDGVSNKDIEKETAKDSSSEPPSMTQLLRR

SEQ ID NO: 35520 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKDGVSNKDIEKETAKDSSAEPPSMTQLLRR

SEQ ID NO: 35521 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKDGVSNKDIEKETAKDSAGEPPSMTQLLRR

SEQ ID NO: 35522 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKDGVSNKDIEKETAKDSASEPPSMTQLLRR

SEQ ID NO: 35523 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKDGVSNKDIEKETAKDSAAEPPSMTQLLRR

SEQ ID NO: 35524 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKDGVSNKDIEKETAKDAGGEPPSMTQLLRR

SEQ ID NO: 35525 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKDGVSNKDIEKETAKDAGSEPPSMTQLLRR

SEQ ID NO: 35526 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKDGVSNKDIEKETAKDAGAEPPSMTQLLRR

SEQ ID NO: 35527 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKDGVSNKDIEKETAKDASGEPPSMTQLLRR

SEQ ID NO: 35528 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKDGVSNKDIEKETAKDASSEPPSMTQLLRR

SEQ ID NO: 35529 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKDGVSNKDIEKETAKDASAEPPSMTQLLRR

SEQ ID NO: 35530 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKDGVSNKDIEKETAKDAAGEPPSMTQLLRR

SEQ ID NO: 35531 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKDGVSNKDIEKETAKDAASEPPSMTQLLRR

SEQ ID NO: 35532 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKDGVSNKDIEKETAKDAAAEPPSMTQLLRR

SEQ ID NO: 35533 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKHGVSNKDIEKETAKDGGGEPPSMTQLLRR

SEQ ID NO: 35534 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKHGVSNKDIEKETAKDGGSEPPSMTQLLRR

SEQ ID NO: 35535 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKHGVSNKDIEKETAKDGGAEPPSMTQLLRR

SEQ ID NO: 35536 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKHGVSNKDIEKETAKDGSGEPPSMTQLLRR

SEQ ID NO: 35537 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKHGVSNKDIEKETAKDGSSEPPSMTQLLRR

SEQ ID NO: 35538 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKHGVSNKDIEKETAKDGSAEPPSMTQLLRR

SEQ ID NO: 35539 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKHGVSNKDIEKETAKDGAGEPPSMTQLLRR

SEQ ID NO: 35540 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKHGVSNKDIEKETAKDGASEPPSMTQLLRR

SEQ ID NO: 35541 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKHGVSNKDIEKETAKDGAAEPPSMTQLLRR

SEQ ID NO: 35542 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKHGVSNKDIEKETAKDSGGEPPSMTQLLRR

SEQ ID NO: 35543 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKHGVSNKDIEKETAKDSGSEPPSMTQLLRR

SEQ ID NO: 35544 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKHGVSNKDIEKETAKDSGAEPPSMTQLLRR

SEQ ID NO: 35545 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKHGVSNKDIEKETAKDSSGEPPSMTQLLRR

SEQ ID NO: 35546 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKHGVSNKDIEKETAKDSSSEPPSMTQLLRR

SEQ ID NO: 35547 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKHGVSNKDIEKETAKDSSAEPPSMTQLLRR

SEQ ID NO: 35548 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKHGVSNKDIEKETAKDSAGEPPSMTQLLRR

SEQ ID NO: 35549 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKHGVSNKDIEKETAKDSASEPPSMTQLLRR

SEQ ID NO: 35550 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKHGVSNKDIEKETAKDSAAEPPSMTQLLRR

SEQ ID NO: 35551 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKHGVSNKDIEKETAKDAGGEPPSMTQLLRR

SEQ ID NO: 35552 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKHGVSNKDIEKETAKDAGSEPPSMTQLLRR

SEQ ID NO: 35553 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKHGVSNKDIEKETAKDAGAEPPSMTQLLRR

SEQ ID NO: 35554 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKHGVSNKDIEKETAKDASGEPPSMTQLLRR

SEQ ID NO: 35555 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKHGVSNKDIEKETAKDASSEPPSMTQLLRR

SEQ ID NO: 35556 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKHGVSNKDIEKETAKDASAEPPSMTQLLRR

SEQ ID NO: 35557 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKHGVSNKDIEKETAKDAAGEPPSMTQLLRR

SEQ ID NO: 35558 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKHGVSNKDIEKETAKDAASEPPSMTQLLRR

SEQ ID NO: 35559 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKHGVSNKDIEKETAKDAAAEPPSMTQLLRR

SEQ ID NO: 35560 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKYGVSNKDIEKETAKDGGGEPPSMTQLLRR

SEQ ID NO: 35561 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKYGVSNKDIEKETAKDGGSEPPSMTQLLRR

SEQ ID NO: 35562 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKYGVSNKDIEKETAKDGGAEPPSMTQLLRR

SEQ ID NO: 35563 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKYGVSNKDIEKETAKDGSGEPPSMTQLLRR

SEQ ID NO: 35564 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKYGVSNKDIEKETAKDGSSEPPSMTQLLRR

SEQ ID NO: 35565 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKYGVSNKDIEKETAKDGSAEPPSMTQLLRR

SEQ ID NO: 35566 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKYGVSNKDIEKETAKDGAGEPPSMTQLLRR

SEQ ID NO: 35567 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKYGVSNKDIEKETAKDGASEPPSMTQLLRR

SEQ ID NO: 35568 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKYGVSNKDIEKETAKDGAAEPPSMTQLLRR

SEQ ID NO: 35569 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKYGVSNKDIEKETAKDSGGEPPSMTQLLRR

SEQ ID NO: 35570 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKYGVSNKDIEKETAKDSGSEPPSMTQLLRR

SEQ ID NO: 35571 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKYGVSNKDIEKETAKDSGAEPPSMTQLLRR

SEQ ID NO: 35572 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKYGVSNKDIEKETAKDSSGEPPSMTQLLRR

SEQ ID NO: 35573 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKYGVSNKDIEKETAKDSSSEPPSMTQLLRR

SEQ ID NO: 35574 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKYGVSNKDIEKETAKDSSAEPPSMTQLLRR

SEQ ID NO: 35575 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKYGVSNKDIEKETAKDSAGEPPSMTQLLRR

SEQ ID NO: 35576 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKYGVSNKDIEKETAKDSASEPPSMTQLLRR

SEQ ID NO: 35577 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKYGVSNKDIEKETAKDSAAEPPSMTQLLRR

SEQ ID NO: 35578 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKYGVSNKDIEKETAKDAGGEPPSMTQLLRR

SEQ ID NO: 35579 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKYGVSNKDIEKETAKDAGSEPPSMTQLLRR

SEQ ID NO: 35580 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKYGVSNKDIEKETAKDAGAEPPSMTQLLRR

SEQ ID NO: 35581 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKYGVSNKDIEKETAKDASGEPPSMTQLLRR

SEQ ID NO: 35582 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKYGVSNKDIEKETAKDASSEPPSMTQLLRR

SEQ ID NO: 35583 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKYGVSNKDIEKETAKDASAEPPSMTQLLRR

SEQ ID NO: 35584 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKYGVSNKDIEKETAKDAAGEPPSMTQLLRR

SEQ ID NO: 35585 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKYGVSNKDIEKETAKDAASEPPSMTQLLRR

SEQ ID NO: 35586 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKYGVSNKDIEKETAKDAAAEPPSMTQLLRR

SEQ ID NO: 35587 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKKGVSNKDIEKETAKDGGGEPPSMTQLLRR

SEQ ID NO: 35588 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKKGVSNKDIEKETAKDGGSEPPSMTQLLRR

SEQ ID NO: 35589 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKKGVSNKDIEKETAKDGGAEPPSMTQLLRR

SEQ ID NO: 35590 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKKGVSNKDIEKETAKDGSGEPPSMTQLLRR

SEQ ID NO: 35591 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKKGVSNKDIEKETAKDGSSEPPSMTQLLRR

SEQ ID NO: 35592 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKKGVSNKDIEKETAKDGSAEPPSMTQLLRR

SEQ ID NO: 35593 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKKGVSNKDIEKETAKDGAGEPPSMTQLLRR

SEQ ID NO: 35594 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKKGVSNKDIEKETAKDGASEPPSMTQLLRR

SEQ ID NO: 35595 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKKGVSNKDIEKETAKDGAAEPPSMTQLLRR

SEQ ID NO: 35596 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKKGVSNKDIEKETAKDSGGEPPSMTQLLRR

SEQ ID NO: 35597 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKKGVSNKDIEKETAKDSGSEPPSMTQLLRR

SEQ ID NO: 35598 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKKGVSNKDIEKETAKDSGAEPPSMTQLLRR

SEQ ID NO: 35599 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKKGVSNKDIEKETAKDSSGEPPSMTQLLRR

SEQ ID NO: 35600 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKKGVSNKDIEKETAKDSSSEPPSMTQLLRR

SEQ ID NO: 35601 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKKGVSNKDIEKETAKDSSAEPPSMTQLLRR

SEQ ID NO: 35602 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKKGVSNKDIEKETAKDSAGEPPSMTQLLRR

SEQ ID NO: 35603 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKKGVSNKDIEKETAKDSASEPPSMTQLLRR

SEQ ID NO: 35604 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKKGVSNKDIEKETAKDSAAEPPSMTQLLRR

SEQ ID NO: 35605 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKKGVSNKDIEKETAKDAGGEPPSMTQLLRR

SEQ ID NO: 35606 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKKGVSNKDIEKETAKDAGSEPPSMTQLLRR

SEQ ID NO: 35607 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKKGVSNKDIEKETAKDAGAEPPSMTQLLRR

SEQ ID NO: 35608 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKKGVSNKDIEKETAKDASGEPPSMTQLLRR

SEQ ID NO: 35609 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKKGVSNKDIEKETAKDASSEPPSMTQLLRR

SEQ ID NO: 35610 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKKGVSNKDIEKETAKDASAEPPSMTQLLRR

SEQ ID NO: 35611 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKKGVSNKDIEKETAKDAAGEPPSMTQLLRR

SEQ ID NO: 35612 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKKGVSNKDIEKETAKDAASEPPSMTQLLRR

SEQ ID NO: 35613 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKKGVSNKDIEKETAKDAAAEPPSMTQLLRR

SEQ ID NO: 35614 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKNGVSNKDIEKETAKDGGGEPPSMTQLLRR

SEQ ID NO: 35615 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKNGVSNKDIEKETAKDGGSEPPSMTQLLRR

SEQ ID NO: 35616 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKNGVSNKDIEKETAKDGGAEPPSMTQLLRR

SEQ ID NO: 35617 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKNGVSNKDIEKETAKDGSGEPPSMTQLLRR

SEQ ID NO: 35618 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKNGVSNKDIEKETAKDGSSEPPSMTQLLRR

SEQ ID NO: 35619 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKNGVSNKDIEKETAKDGSAEPPSMTQLLRR

SEQ ID NO: 35620 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKNGVSNKDIEKETAKDGAGEPPSMTQLLRR

SEQ ID NO: 35621 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKNGVSNKDIEKETAKDGASEPPSMTQLLRR

SEQ ID NO: 35622 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKNGVSNKDIEKETAKDGAAEPPSMTQLLRR

SEQ ID NO: 35623 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKNGVSNKDIEKETAKDSGGEPPSMTQLLRR

SEQ ID NO: 35624 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKNGVSNKDIEKETAKDSGSEPPSMTQLLRR

SEQ ID NO: 35625 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKNGVSNKDIEKETAKDSGAEPPSMTQLLRR

SEQ ID NO: 35626 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKNGVSNKDIEKETAKDSSGEPPSMTQLLRR

SEQ ID NO: 35627 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKNGVSNKDIEKETAKDSSSEPPSMTQLLRR

SEQ ID NO: 35628 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKNGVSNKDIEKETAKDSSAEPPSMTQLLRR

SEQ ID NO: 35629 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKNGVSNKDIEKETAKDSAGEPPSMTQLLRR

SEQ ID NO: 35630 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKNGVSNKDIEKETAKDSASEPPSMTQLLRR

SEQ ID NO: 35631 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKNGVSNKDIEKETAKDSAAEPPSMTQLLRR

SEQ ID NO: 35632 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKNGVSNKDIEKETAKDAGGEPPSMTQLLRR

SEQ ID NO: 35633 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKNGVSNKDIEKETAKDAGSEPPSMTQLLRR

SEQ ID NO: 35634 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKNGVSNKDIEKETAKDAGAEPPSMTQLLRR

SEQ ID NO: 35635 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKNGVSNKDIEKETAKDASGEPPSMTQLLRR

SEQ ID NO: 35636 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKNGVSNKDIEKETAKDASSEPPSMTQLLRR

SEQ ID NO: 35637 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKNGVSNKDIEKETAKDASAEPPSMTQLLRR

SEQ ID NO: 35638 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKNGVSNKDIEKETAKDAAGEPPSMTQLLRR

SEQ ID NO: 35639 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKNGVSNKDIEKETAKDAASEPPSMTQLLRR

SEQ ID NO: 35640 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKNGVSNKDIEKETAKDAAAEPPSMTQLLRR

SEQ ID NO: 35641 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKMGVSNKDIEKETAKDGGGEPPSMTQLLRR

SEQ ID NO: 35642 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKMGVSNKDIEKETAKDGGSEPPSMTQLLRR

SEQ ID NO: 35643 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKMGVSNKDIEKETAKDGGAEPPSMTQLLRR

SEQ ID NO: 35644 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKMGVSNKDIEKETAKDGSGEPPSMTQLLRR

SEQ ID NO: 35645 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKMGVSNKDIEKETAKDGSSEPPSMTQLLRR

SEQ ID NO: 35646 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKMGVSNKDIEKETAKDGSAEPPSMTQLLRR

SEQ ID NO: 35647 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKMGVSNKDIEKETAKDGAGEPPSMTQLLRR

SEQ ID NO: 35648 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKMGVSNKDIEKETAKDGASEPPSMTQLLRR

SEQ ID NO: 35649 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKMGVSNKDIEKETAKDGAAEPPSMTQLLRR

SEQ ID NO: 35650 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKMGVSNKDIEKETAKDSGGEPPSMTQLLRR

SEQ ID NO: 35651 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKMGVSNKDIEKETAKDSGSEPPSMTQLLRR

SEQ ID NO: 35652 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKMGVSNKDIEKETAKDSGAEPPSMTQLLRR

SEQ ID NO: 35653 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKMGVSNKDIEKETAKDSSGEPPSMTQLLRR

SEQ ID NO: 35654 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKMGVSNKDIEKETAKDSSSEPPSMTQLLRR

SEQ ID NO: 35655 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKMGVSNKDIEKETAKDSSAEPPSMTQLLRR

SEQ ID NO: 35656 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKMGVSNKDIEKETAKDSAGEPPSMTQLLRR

SEQ ID NO: 35657 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKMGVSNKDIEKETAKDSASEPPSMTQLLRR

SEQ ID NO: 35658 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKMGVSNKDIEKETAKDSAAEPPSMTQLLRR

SEQ ID NO: 35659 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKMGVSNKDIEKETAKDAGGEPPSMTQLLRR

SEQ ID NO: 35660 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKMGVSNKDIEKETAKDAGSEPPSMTQLLRR

SEQ ID NO: 35661 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKMGVSNKDIEKETAKDAGAEPPSMTQLLRR

SEQ ID NO: 35662 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKMGVSNKDIEKETAKDASGEPPSMTQLLRR

SEQ ID NO: 35663 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKMGVSNKDIEKETAKDASSEPPSMTQLLRR

SEQ ID NO: 35664 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKMGVSNKDIEKETAKDASAEPPSMTQLLRR

SEQ ID NO: 35665 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKMGVSNKDIEKETAKDAAGEPPSMTQLLRR

SEQ ID NO: 35666 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKMGVSNKDIEKETAKDAASEPPSMTQLLRR

SEQ ID NO: 35667 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKMGVSNKDIEKETAKDAAAEPPSMTQLLRR

SEQ ID NO: 35668 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKCGVSNKDIEKETAKDGGGEPPSMTQLLRR

SEQ ID NO: 35669 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKCGVSNKDIEKETAKDGGSEPPSMTQLLRR

SEQ ID NO: 35670 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKCGVSNKDIEKETAKDGGAEPPSMTQLLRR

SEQ ID NO: 35671 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKCGVSNKDIEKETAKDGSGEPPSMTQLLRR

SEQ ID NO: 35672 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKCGVSNKDIEKETAKDGSSEPPSMTQLLRR

SEQ ID NO: 35673 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKCGVSNKDIEKETAKDGSAEPPSMTQLLRR

SEQ ID NO: 35674 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKCGVSNKDIEKETAKDGAGEPPSMTQLLRR

SEQ ID NO: 35675 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKCGVSNKDIEKETAKDGASEPPSMTQLLRR

SEQ ID NO: 35676 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKCGVSNKDIEKETAKDGAAEPPSMTQLLRR

SEQ ID NO: 35677 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKCGVSNKDIEKETAKDSGGEPPSMTQLLRR

SEQ ID NO: 35678 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKCGVSNKDIEKETAKDSGSEPPSMTQLLRR

SEQ ID NO: 35679 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKCGVSNKDIEKETAKDSGAEPPSMTQLLRR

SEQ ID NO: 35680 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKCGVSNKDIEKETAKDSSGEPPSMTQLLRR

SEQ ID NO: 35681 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKCGVSNKDIEKETAKDSSSEPPSMTQLLRR

SEQ ID NO: 35682 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKCGVSNKDIEKETAKDSSAEPPSMTQLLRR

SEQ ID NO: 35683 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKCGVSNKDIEKETAKDSAGEPPSMTQLLRR

SEQ ID NO: 35684 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKCGVSNKDIEKETAKDSASEPPSMTQLLRR

SEQ ID NO: 35685 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKCGVSNKDIEKETAKDSAAEPPSMTQLLRR

SEQ ID NO: 35686 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKCGVSNKDIEKETAKDAGGEPPSMTQLLRR

SEQ ID NO: 35687 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKCGVSNKDIEKETAKDAGSEPPSMTQLLRR

SEQ ID NO: 35688 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKCGVSNKDIEKETAKDAGAEPPSMTQLLRR

SEQ ID NO: 35689 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKCGVSNKDIEKETAKDASGEPPSMTQLLRR

SEQ ID NO: 35690 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKCGVSNKDIEKETAKDASSEPPSMTQLLRR

SEQ ID NO: 35691 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKCGVSNKDIEKETAKDASAEPPSMTQLLRR

SEQ ID NO: 35692 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKCGVSNKDIEKETAKDAAGEPPSMTQLLRR

SEQ ID NO: 35693 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKCGVSNKDIEKETAKDAASEPPSMTQLLRR

SEQ ID NO: 35694 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKCGVSNKDIEKETAKDAAAEPPSMTQLLRR

SEQ ID NO: 35695 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKSGVSNKDIEKETAKDGGGEPPSMTQLLRR

SEQ ID NO: 35696 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKSGVSNKDIEKETAKDGGSEPPSMTQLLRR

SEQ ID NO: 35697 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKSGVSNKDIEKETAKDGGAEPPSMTQLLRR

SEQ ID NO: 35698 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKSGVSNKDIEKETAKDGSGEPPSMTQLLRR

SEQ ID NO: 35699 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKSGVSNKDIEKETAKDGSSEPPSMTQLLRR

SEQ ID NO: 35700 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKSGVSNKDIEKETAKDGSAEPPSMTQLLRR

SEQ ID NO: 35701 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKSGVSNKDIEKETAKDGAGEPPSMTQLLRR

SEQ ID NO: 35702 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKSGVSNKDIEKETAKDGASEPPSMTQLLRR

SEQ ID NO: 35703 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKSGVSNKDIEKETAKDGAAEPPSMTQLLRR

SEQ ID NO: 35704 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKSGVSNKDIEKETAKDSGGEPPSMTQLLRR

SEQ ID NO: 35705 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKSGVSNKDIEKETAKDSGSEPPSMTQLLRR

SEQ ID NO: 35706 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKSGVSNKDIEKETAKDSGAEPPSMTQLLRR

SEQ ID NO: 35707 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKSGVSNKDIEKETAKDSSGEPPSMTQLLRR

SEQ ID NO: 35708 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKSGVSNKDIEKETAKDSSSEPPSMTQLLRR

SEQ ID NO: 35709 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKSGVSNKDIEKETAKDSSAEPPSMTQLLRR

SEQ ID NO: 35710 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKSGVSNKDIEKETAKDSAGEPPSMTQLLRR

SEQ ID NO: 35711 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKSGVSNKDIEKETAKDSASEPPSMTQLLRR

SEQ ID NO: 35712 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKSGVSNKDIEKETAKDSAAEPPSMTQLLRR

SEQ ID NO: 35713 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKSGVSNKDIEKETAKDAGGEPPSMTQLLRR

SEQ ID NO: 35714 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKSGVSNKDIEKETAKDAGSEPPSMTQLLRR

SEQ ID NO: 35715 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKSGVSNKDIEKETAKDAGAEPPSMTQLLRR

SEQ ID NO: 35716 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKSGVSNKDIEKETAKDASGEPPSMTQLLRR

SEQ ID NO: 35717 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKSGVSNKDIEKETAKDASSEPPSMTQLLRR

SEQ ID NO: 35718 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKSGVSNKDIEKETAKDASAEPPSMTQLLRR

SEQ ID NO: 35719 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKSGVSNKDIEKETAKDAAGEPPSMTQLLRR

SEQ ID NO: 35720 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKSGVSNKDIEKETAKDAASEPPSMTQLLRR

SEQ ID NO: 35721 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKSGVSNKDIEKETAKDAAAEPPSMTQLLRR

SEQ ID NO: 35722 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKAGVSNKDIEKETAKDGGGEPPSMTQLLRR

SEQ ID NO: 35723 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKAGVSNKDIEKETAKDGGSEPPSMTQLLRR

SEQ ID NO: 35724 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKAGVSNKDIEKETAKDGGAEPPSMTQLLRR

SEQ ID NO: 35725 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKAGVSNKDIEKETAKDGSGEPPSMTQLLRR

SEQ ID NO: 35726 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKAGVSNKDIEKETAKDGSSEPPSMTQLLRR

SEQ ID NO: 35727 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKAGVSNKDIEKETAKDGSAEPPSMTQLLRR

SEQ ID NO: 35728 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKAGVSNKDIEKETAKDGAGEPPSMTQLLRR

SEQ ID NO: 35729 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKAGVSNKDIEKETAKDGASEPPSMTQLLRR

SEQ ID NO: 35730 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKAGVSNKDIEKETAKDGAAEPPSMTQLLRR

SEQ ID NO: 35731 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKAGVSNKDIEKETAKDSGGEPPSMTQLLRR

SEQ ID NO: 35732 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKAGVSNKDIEKETAKDSGSEPPSMTQLLRR

SEQ ID NO: 35733 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKAGVSNKDIEKETAKDSGAEPPSMTQLLRR

SEQ ID NO: 35734 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKAGVSNKDIEKETAKDSSGEPPSMTQLLRR

SEQ ID NO: 35735 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKAGVSNKDIEKETAKDSSSEPPSMTQLLRR

SEQ ID NO: 35736 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKAGVSNKDIEKETAKDSSAEPPSMTQLLRR

SEQ ID NO: 35737 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKAGVSNKDIEKETAKDSAGEPPSMTQLLRR

SEQ ID NO: 35738 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKAGVSNKDIEKETAKDSASEPPSMTQLLRR

SEQ ID NO: 35739 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKAGVSNKDIEKETAKDSAAEPPSMTQLLRR

SEQ ID NO: 35740 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKAGVSNKDIEKETAKDAGGEPPSMTQLLRR

SEQ ID NO: 35741 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKAGVSNKDIEKETAKDAGSEPPSMTQLLRR

SEQ ID NO: 35742 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKAGVSNKDIEKETAKDAGAEPPSMTQLLRR

SEQ ID NO: 35743 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKAGVSNKDIEKETAKDASGEPPSMTQLLRR

SEQ ID NO: 35744 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKAGVSNKDIEKETAKDASSEPPSMTQLLRR

SEQ ID NO: 35745 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKAGVSNKDIEKETAKDASAEPPSMTQLLRR

SEQ ID NO: 35746 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKAGVSNKDIEKETAKDAAGEPPSMTQLLRR

SEQ ID NO: 35747 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKAGVSNKDIEKETAKDAASEPPSMTQLLRR

SEQ ID NO: 35748 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKAGVSNKDIEKETAKDAAAEPPSMTQLLRR

SEQ ID NO: 35749 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKGGVSNKDIEKETAKDGGGEPPSMTQLLRR

SEQ ID NO: 35750 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKGGVSNKDIEKETAKDGGSEPPSMTQLLRR

SEQ ID NO: 35751 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKGGVSNKDIEKETAKDGGAEPPSMTQLLRR

SEQ ID NO: 35752 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKGGVSNKDIEKETAKDGSGEPPSMTQLLRR

SEQ ID NO: 35753 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKGGVSNKDIEKETAKDGSSEPPSMTQLLRR

SEQ ID NO: 35754 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKGGVSNKDIEKETAKDGSAEPPSMTQLLRR

SEQ ID NO: 35755 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKGGVSNKDIEKETAKDGAGEPPSMTQLLRR

SEQ ID NO: 35756 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKGGVSNKDIEKETAKDGASEPPSMTQLLRR

SEQ ID NO: 35757 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKGGVSNKDIEKETAKDGAAEPPSMTQLLRR

SEQ ID NO: 35758 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKGGVSNKDIEKETAKDSGGEPPSMTQLLRR

SEQ ID NO: 35759 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKGGVSNKDIEKETAKDSGSEPPSMTQLLRR

SEQ ID NO: 35760 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKGGVSNKDIEKETAKDSGAEPPSMTQLLRR

SEQ ID NO: 35761 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKGGVSNKDIEKETAKDSSGEPPSMTQLLRR

SEQ ID NO: 35762 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKGGVSNKDIEKETAKDSSSEPPSMTQLLRR

SEQ ID NO: 35763 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKGGVSNKDIEKETAKDSSAEPPSMTQLLRR

SEQ ID NO: 35764 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKGGVSNKDIEKETAKDSAGEPPSMTQLLRR

SEQ ID NO: 35765 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKGGVSNKDIEKETAKDSASEPPSMTQLLRR

SEQ ID NO: 35766 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKGGVSNKDIEKETAKDSAAEPPSMTQLLRR

SEQ ID NO: 35767 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKGGVSNKDIEKETAKDAGGEPPSMTQLLRR

SEQ ID NO: 35768 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKGGVSNKDIEKETAKDAGSEPPSMTQLLRR

SEQ ID NO: 35769 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKGGVSNKDIEKETAKDAGAEPPSMTQLLRR

SEQ ID NO: 35770 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKGGVSNKDIEKETAKDASGEPPSMTQLLRR

SEQ ID NO: 35771 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKGGVSNKDIEKETAKDASSEPPSMTQLLRR

SEQ ID NO: 35772 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKGGVSNKDIEKETAKDASAEPPSMTQLLRR

SEQ ID NO: 35773 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKGGVSNKDIEKETAKDAAGEPPSMTQLLRR

SEQ ID NO: 35774 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKGGVSNKDIEKETAKDAASEPPSMTQLLRR

SEQ ID NO: 35775 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKGGVSNKDIEKETAKDAAAEPPSMTQLLRR

SEQ ID NO: 35776 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKDGVSNKDIEKETAKDGGGEPPSMTQLLRR

SEQ ID NO: 35777 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKDGVSNKDIEKETAKDGGSEPPSMTQLLRR

SEQ ID NO: 35778 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKDGVSNKDIEKETAKDGGAEPPSMTQLLRR

SEQ ID NO: 35779 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKDGVSNKDIEKETAKDGSGEPPSMTQLLRR

SEQ ID NO: 35780 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKDGVSNKDIEKETAKDGSSEPPSMTQLLRR

SEQ ID NO: 35781 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKDGVSNKDIEKETAKDGSAEPPSMTQLLRR

SEQ ID NO: 35782 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKDGVSNKDIEKETAKDGAGEPPSMTQLLRR

SEQ ID NO: 35783 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKDGVSNKDIEKETAKDGASEPPSMTQLLRR

SEQ ID NO: 35784 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKDGVSNKDIEKETAKDGAAEPPSMTQLLRR

SEQ ID NO: 35785 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKDGVSNKDIEKETAKDSGGEPPSMTQLLRR

SEQ ID NO: 35786 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKDGVSNKDIEKETAKDSGSEPPSMTQLLRR

SEQ ID NO: 35787 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKDGVSNKDIEKETAKDSGAEPPSMTQLLRR

SEQ ID NO: 35788 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKDGVSNKDIEKETAKDSSGEPPSMTQLLRR

SEQ ID NO: 35789 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKDGVSNKDIEKETAKDSSSEPPSMTQLLRR

SEQ ID NO: 35790 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKDGVSNKDIEKETAKDSSAEPPSMTQLLRR

SEQ ID NO: 35791 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKDGVSNKDIEKETAKDSAGEPPSMTQLLRR

SEQ ID NO: 35792 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKDGVSNKDIEKETAKDSASEPPSMTQLLRR

SEQ ID NO: 35793 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKDGVSNKDIEKETAKDSAAEPPSMTQLLRR

SEQ ID NO: 35794 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKDGVSNKDIEKETAKDAGGEPPSMTQLLRR

SEQ ID NO: 35795 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKDGVSNKDIEKETAKDAGSEPPSMTQLLRR

SEQ ID NO: 35796 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKDGVSNKDIEKETAKDAGAEPPSMTQLLRR

SEQ ID NO: 35797 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKDGVSNKDIEKETAKDASGEPPSMTQLLRR

SEQ ID NO: 35798 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKDGVSNKDIEKETAKDASSEPPSMTQLLRR

SEQ ID NO: 35799 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKDGVSNKDIEKETAKDASAEPPSMTQLLRR

SEQ ID NO: 35800 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKDGVSNKDIEKETAKDAAGEPPSMTQLLRR

SEQ ID NO: 35801 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKDGVSNKDIEKETAKDAASEPPSMTQLLRR

SEQ ID NO: 35802 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKDGVSNKDIEKETAKDAAAEPPSMTQLLRR

SEQ ID NO: 35803 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKHGVSNKDIEKETAKDGGGEPPSMTQLLRR

SEQ ID NO: 35804 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKHGVSNKDIEKETAKDGGSEPPSMTQLLRR

SEQ ID NO: 35805 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKHGVSNKDIEKETAKDGGAEPPSMTQLLRR

SEQ ID NO: 35806 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKHGVSNKDIEKETAKDGSGEPPSMTQLLRR

SEQ ID NO: 35807 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKHGVSNKDIEKETAKDGSSEPPSMTQLLRR

SEQ ID NO: 35808 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKHGVSNKDIEKETAKDGSAEPPSMTQLLRR

SEQ ID NO: 35809 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKHGVSNKDIEKETAKDGAGEPPSMTQLLRR

SEQ ID NO: 35810 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKHGVSNKDIEKETAKDGASEPPSMTQLLRR

SEQ ID NO: 35811 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKHGVSNKDIEKETAKDGAAEPPSMTQLLRR

SEQ ID NO: 35812 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKHGVSNKDIEKETAKDSGGEPPSMTQLLRR

SEQ ID NO: 35813 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKHGVSNKDIEKETAKDSGSEPPSMTQLLRR

SEQ ID NO: 35814 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKHGVSNKDIEKETAKDSGAEPPSMTQLLRR

SEQ ID NO: 35815 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKHGVSNKDIEKETAKDSSGEPPSMTQLLRR

SEQ ID NO: 35816 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKHGVSNKDIEKETAKDSSSEPPSMTQLLRR

SEQ ID NO: 35817 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKHGVSNKDIEKETAKDSSAEPPSMTQLLRR

SEQ ID NO: 35818 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKHGVSNKDIEKETAKDSAGEPPSMTQLLRR

SEQ ID NO: 35819 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKHGVSNKDIEKETAKDSASEPPSMTQLLRR

SEQ ID NO: 35820 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKHGVSNKDIEKETAKDSAAEPPSMTQLLRR

SEQ ID NO: 35821 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKHGVSNKDIEKETAKDAGGEPPSMTQLLRR

SEQ ID NO: 35822 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKHGVSNKDIEKETAKDAGSEPPSMTQLLRR

SEQ ID NO: 35823 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKHGVSNKDIEKETAKDAGAEPPSMTQLLRR

SEQ ID NO: 35824 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKHGVSNKDIEKETAKDASGEPPSMTQLLRR

SEQ ID NO: 35825 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKHGVSNKDIEKETAKDASSEPPSMTQLLRR

SEQ ID NO: 35826 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKHGVSNKDIEKETAKDASAEPPSMTQLLRR

SEQ ID NO: 35827 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKHGVSNKDIEKETAKDAAGEPPSMTQLLRR

SEQ ID NO: 35828 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKHGVSNKDIEKETAKDAASEPPSMTQLLRR

SEQ ID NO: 35829 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKHGVSNKDIEKETAKDAAAEPPSMTQLLRR

SEQ ID NO: 35830 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKYGVSNKDIEKETAKDGGGEPPSMTQLLRR

SEQ ID NO: 35831 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKYGVSNKDIEKETAKDGGSEPPSMTQLLRR

SEQ ID NO: 35832 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKYGVSNKDIEKETAKDGGAEPPSMTQLLRR

SEQ ID NO: 35833 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKYGVSNKDIEKETAKDGSGEPPSMTQLLRR

SEQ ID NO: 35834 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKYGVSNKDIEKETAKDGSSEPPSMTQLLRR

SEQ ID NO: 35835 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKYGVSNKDIEKETAKDGSAEPPSMTQLLRR

SEQ ID NO: 35836 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKYGVSNKDIEKETAKDGAGEPPSMTQLLRR

SEQ ID NO: 35837 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKYGVSNKDIEKETAKDGASEPPSMTQLLRR

SEQ ID NO: 35838 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKYGVSNKDIEKETAKDGAAEPPSMTQLLRR

SEQ ID NO: 35839 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKYGVSNKDIEKETAKDSGGEPPSMTQLLRR

SEQ ID NO: 35840 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKYGVSNKDIEKETAKDSGSEPPSMTQLLRR

SEQ ID NO: 35841 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKYGVSNKDIEKETAKDSGAEPPSMTQLLRR

SEQ ID NO: 35842 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKYGVSNKDIEKETAKDSSGEPPSMTQLLRR

SEQ ID NO: 35843 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKYGVSNKDIEKETAKDSSSEPPSMTQLLRR

SEQ ID NO: 35844 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKYGVSNKDIEKETAKDSSAEPPSMTQLLRR

SEQ ID NO: 35845 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKYGVSNKDIEKETAKDSAGEPPSMTQLLRR

SEQ ID NO: 35846 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKYGVSNKDIEKETAKDSASEPPSMTQLLRR

SEQ ID NO: 35847 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKYGVSNKDIEKETAKDSAAEPPSMTQLLRR

SEQ ID NO: 35848 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKYGVSNKDIEKETAKDAGGEPPSMTQLLRR

SEQ ID NO: 35849 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKYGVSNKDIEKETAKDAGSEPPSMTQLLRR

SEQ ID NO: 35850 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKYGVSNKDIEKETAKDAGAEPPSMTQLLRR

SEQ ID NO: 35851 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKYGVSNKDIEKETAKDASGEPPSMTQLLRR

SEQ ID NO: 35852 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKYGVSNKDIEKETAKDASSEPPSMTQLLRR

SEQ ID NO: 35853 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKYGVSNKDIEKETAKDASAEPPSMTQLLRR

SEQ ID NO: 35854 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKYGVSNKDIEKETAKDAAGEPPSMTQLLRR

SEQ ID NO: 35855 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKYGVSNKDIEKETAKDAASEPPSMTQLLRR

SEQ ID NO: 35856 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKYGVSNKDIEKETAKDAAAEPPSMTQLLRR

SEQ ID NO: 35857 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKKGVSNKDIEKETAKDGGGEPPSMTQLLRR

SEQ ID NO: 35858 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKKGVSNKDIEKETAKDGGSEPPSMTQLLRR

SEQ ID NO: 35859 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKKGVSNKDIEKETAKDGGAEPPSMTQLLRR

SEQ ID NO: 35860 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKKGVSNKDIEKETAKDGSGEPPSMTQLLRR

SEQ ID NO: 35861 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKKGVSNKDIEKETAKDGSSEPPSMTQLLRR

SEQ ID NO: 35862 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKKGVSNKDIEKETAKDGSAEPPSMTQLLRR

SEQ ID NO: 35863 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKKGVSNKDIEKETAKDGAGEPPSMTQLLRR

SEQ ID NO: 35864 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKKGVSNKDIEKETAKDGASEPPSMTQLLRR

SEQ ID NO: 35865 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKKGVSNKDIEKETAKDGAAEPPSMTQLLRR

SEQ ID NO: 35866 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKKGVSNKDIEKETAKDSGGEPPSMTQLLRR

SEQ ID NO: 35867 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKKGVSNKDIEKETAKDSGSEPPSMTQLLRR

SEQ ID NO: 35868 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKKGVSNKDIEKETAKDSGAEPPSMTQLLRR

SEQ ID NO: 35869 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKKGVSNKDIEKETAKDSSGEPPSMTQLLRR

SEQ ID NO: 35870 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKKGVSNKDIEKETAKDSSSEPPSMTQLLRR

SEQ ID NO: 35871 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKKGVSNKDIEKETAKDSSAEPPSMTQLLRR

SEQ ID NO: 35872 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKKGVSNKDIEKETAKDSAGEPPSMTQLLRR

SEQ ID NO: 35873 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKKGVSNKDIEKETAKDSASEPPSMTQLLRR

SEQ ID NO: 35874 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKKGVSNKDIEKETAKDSAAEPPSMTQLLRR

SEQ ID NO: 35875 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKKGVSNKDIEKETAKDAGGEPPSMTQLLRR

SEQ ID NO: 35876 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKKGVSNKDIEKETAKDAGSEPPSMTQLLRR

SEQ ID NO: 35877 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKKGVSNKDIEKETAKDAGAEPPSMTQLLRR

SEQ ID NO: 35878 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKKGVSNKDIEKETAKDASGEPPSMTQLLRR

SEQ ID NO: 35879 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKKGVSNKDIEKETAKDASSEPPSMTQLLRR

SEQ ID NO: 35880 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKKGVSNKDIEKETAKDASAEPPSMTQLLRR

SEQ ID NO: 35881 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKKGVSNKDIEKETAKDAAGEPPSMTQLLRR

SEQ ID NO: 35882 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKKGVSNKDIEKETAKDAASEPPSMTQLLRR

SEQ ID NO: 35883 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKKGVSNKDIEKETAKDAAAEPPSMTQLLRR

SEQ ID NO: 35884 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKNGVSNKDIEKETAKDGGGEPPSMTQLLRR

SEQ ID NO: 35885 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKNGVSNKDIEKETAKDGGSEPPSMTQLLRR

SEQ ID NO: 35886 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKNGVSNKDIEKETAKDGGAEPPSMTQLLRR

SEQ ID NO: 35887 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKNGVSNKDIEKETAKDGSGEPPSMTQLLRR

SEQ ID NO: 35888 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKNGVSNKDIEKETAKDGSSEPPSMTQLLRR

SEQ ID NO: 35889 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKNGVSNKDIEKETAKDGSAEPPSMTQLLRR

SEQ ID NO: 35890 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKNGVSNKDIEKETAKDGAGEPPSMTQLLRR

SEQ ID NO: 35891 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKNGVSNKDIEKETAKDGASEPPSMTQLLRR

SEQ ID NO: 35892 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKNGVSNKDIEKETAKDGAAEPPSMTQLLRR

SEQ ID NO: 35893 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKNGVSNKDIEKETAKDSGGEPPSMTQLLRR

SEQ ID NO: 35894 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKNGVSNKDIEKETAKDSGSEPPSMTQLLRR

SEQ ID NO: 35895 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKNGVSNKDIEKETAKDSGAEPPSMTQLLRR

SEQ ID NO: 35896 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKNGVSNKDIEKETAKDSSGEPPSMTQLLRR

SEQ ID NO: 35897 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKNGVSNKDIEKETAKDSSSEPPSMTQLLRR

SEQ ID NO: 35898 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKNGVSNKDIEKETAKDSSAEPPSMTQLLRR

SEQ ID NO: 35899 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKNGVSNKDIEKETAKDSAGEPPSMTQLLRR

SEQ ID NO: 35900 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKNGVSNKDIEKETAKDSASEPPSMTQLLRR

SEQ ID NO: 35901 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKNGVSNKDIEKETAKDSAAEPPSMTQLLRR

SEQ ID NO: 35902 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKNGVSNKDIEKETAKDAGGEPPSMTQLLRR

SEQ ID NO: 35903 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKNGVSNKDIEKETAKDAGSEPPSMTQLLRR

SEQ ID NO: 35904 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKNGVSNKDIEKETAKDAGAEPPSMTQLLRR

SEQ ID NO: 35905 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKNGVSNKDIEKETAKDASGEPPSMTQLLRR

SEQ ID NO: 35906 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKNGVSNKDIEKETAKDASSEPPSMTQLLRR

SEQ ID NO: 35907 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKNGVSNKDIEKETAKDASAEPPSMTQLLRR

SEQ ID NO: 35908 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKNGVSNKDIEKETAKDAAGEPPSMTQLLRR

SEQ ID NO: 35909 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKNGVSNKDIEKETAKDAASEPPSMTQLLRR

SEQ ID NO: 35910 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKNGVSNKDIEKETAKDAAAEPPSMTQLLRR

SEQ ID NO: 35911 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKMGVSNKDIEKETAKDGGGEPPSMTQLLRR

SEQ ID NO: 35912 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKMGVSNKDIEKETAKDGGSEPPSMTQLLRR

SEQ ID NO: 35913 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKMGVSNKDIEKETAKDGGAEPPSMTQLLRR

SEQ ID NO: 35914 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKMGVSNKDIEKETAKDGSGEPPSMTQLLRR

SEQ ID NO: 35915 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKMGVSNKDIEKETAKDGSSEPPSMTQLLRR

SEQ ID NO: 35916 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKMGVSNKDIEKETAKDGSAEPPSMTQLLRR

SEQ ID NO: 35917 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKMGVSNKDIEKETAKDGAGEPPSMTQLLRR

SEQ ID NO: 35918 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKMGVSNKDIEKETAKDGASEPPSMTQLLRR

SEQ ID NO: 35919 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKMGVSNKDIEKETAKDGAAEPPSMTQLLRR

SEQ ID NO: 35920 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKMGVSNKDIEKETAKDSGGEPPSMTQLLRR

SEQ ID NO: 35921 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKMGVSNKDIEKETAKDSGSEPPSMTQLLRR

SEQ ID NO: 35922 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKMGVSNKDIEKETAKDSGAEPPSMTQLLRR

SEQ ID NO: 35923 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKMGVSNKDIEKETAKDSSGEPPSMTQLLRR

SEQ ID NO: 35924 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKMGVSNKDIEKETAKDSSSEPPSMTQLLRR

SEQ ID NO: 35925 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKMGVSNKDIEKETAKDSSAEPPSMTQLLRR

SEQ ID NO: 35926 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKMGVSNKDIEKETAKDSAGEPPSMTQLLRR

SEQ ID NO: 35927 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKMGVSNKDIEKETAKDSASEPPSMTQLLRR

SEQ ID NO: 35928 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKMGVSNKDIEKETAKDSAAEPPSMTQLLRR

SEQ ID NO: 35929 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKMGVSNKDIEKETAKDAGGEPPSMTQLLRR

SEQ ID NO: 35930 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKMGVSNKDIEKETAKDAGSEPPSMTQLLRR

SEQ ID NO: 35931 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKMGVSNKDIEKETAKDAGAEPPSMTQLLRR

SEQ ID NO: 35932 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKMGVSNKDIEKETAKDASGEPPSMTQLLRR

SEQ ID NO: 35933 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKMGVSNKDIEKETAKDASSEPPSMTQLLRR

SEQ ID NO: 35934 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKMGVSNKDIEKETAKDASAEPPSMTQLLRR

SEQ ID NO: 35935 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKMGVSNKDIEKETAKDAAGEPPSMTQLLRR

SEQ ID NO: 35936 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKMGVSNKDIEKETAKDAASEPPSMTQLLRR

SEQ ID NO: 35937 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKMGVSNKDIEKETAKDAAAEPPSMTQLLRR

SEQ ID NO: 35938 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKCGVSNKDIEKETAKDGGGEPPSMTQLLRR

SEQ ID NO: 35939 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKCGVSNKDIEKETAKDGGSEPPSMTQLLRR

SEQ ID NO: 35940 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKCGVSNKDIEKETAKDGGAEPPSMTQLLRR

SEQ ID NO: 35941 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKCGVSNKDIEKETAKDGSGEPPSMTQLLRR

SEQ ID NO: 35942 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKCGVSNKDIEKETAKDGSSEPPSMTQLLRR

SEQ ID NO: 35943 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKCGVSNKDIEKETAKDGSAEPPSMTQLLRR

SEQ ID NO: 35944 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKCGVSNKDIEKETAKDGAGEPPSMTQLLRR

SEQ ID NO: 35945 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKCGVSNKDIEKETAKDGASEPPSMTQLLRR

SEQ ID NO: 35946 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKCGVSNKDIEKETAKDGAAEPPSMTQLLRR

SEQ ID NO: 35947 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKCGVSNKDIEKETAKDSGGEPPSMTQLLRR

SEQ ID NO: 35948 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKCGVSNKDIEKETAKDSGSEPPSMTQLLRR

SEQ ID NO: 35949 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKCGVSNKDIEKETAKDSGAEPPSMTQLLRR

SEQ ID NO: 35950 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKCGVSNKDIEKETAKDSSGEPPSMTQLLRR

SEQ ID NO: 35951 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKCGVSNKDIEKETAKDSSSEPPSMTQLLRR

SEQ ID NO: 35952 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKCGVSNKDIEKETAKDSSAEPPSMTQLLRR

SEQ ID NO: 35953 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKCGVSNKDIEKETAKDSAGEPPSMTQLLRR

SEQ ID NO: 35954 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKCGVSNKDIEKETAKDSASEPPSMTQLLRR

SEQ ID NO: 35955 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKCGVSNKDIEKETAKDSAAEPPSMTQLLRR

SEQ ID NO: 35956 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKCGVSNKDIEKETAKDAGGEPPSMTQLLRR

SEQ ID NO: 35957 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKCGVSNKDIEKETAKDAGSEPPSMTQLLRR

SEQ ID NO: 35958 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKCGVSNKDIEKETAKDAGAEPPSMTQLLRR

SEQ ID NO: 35959 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKCGVSNKDIEKETAKDASGEPPSMTQLLRR

SEQ ID NO: 35960 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKCGVSNKDIEKETAKDASSEPPSMTQLLRR

SEQ ID NO: 35961 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKCGVSNKDIEKETAKDASAEPPSMTQLLRR

SEQ ID NO: 35962 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKCGVSNKDIEKETAKDAAGEPPSMTQLLRR

SEQ ID NO: 35963 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKCGVSNKDIEKETAKDAASEPPSMTQLLRR

SEQ ID NO: 35964 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKCGVSNKDIEKETAKDAAAEPPSMTQLLRR

SEQ ID NO: 35965 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKSGVSNKDIEKETAKDGGGEPPSMTQLLRR

SEQ ID NO: 35966 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKSGVSNKDIEKETAKDGGSEPPSMTQLLRR

SEQ ID NO: 35967 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKSGVSNKDIEKETAKDGGAEPPSMTQLLRR

SEQ ID NO: 35968 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKSGVSNKDIEKETAKDGSGEPPSMTQLLRR

SEQ ID NO: 35969 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKSGVSNKDIEKETAKDGSSEPPSMTQLLRR

SEQ ID NO: 35970 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKSGVSNKDIEKETAKDGSAEPPSMTQLLRR

SEQ ID NO: 35971 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKSGVSNKDIEKETAKDGAGEPPSMTQLLRR

SEQ ID NO: 35972 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKSGVSNKDIEKETAKDGASEPPSMTQLLRR

SEQ ID NO: 35973 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKSGVSNKDIEKETAKDGAAEPPSMTQLLRR

SEQ ID NO: 35974 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKSGVSNKDIEKETAKDSGGEPPSMTQLLRR

SEQ ID NO: 35975 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKSGVSNKDIEKETAKDSGSEPPSMTQLLRR

SEQ ID NO: 35976 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKSGVSNKDIEKETAKDSGAEPPSMTQLLRR

SEQ ID NO: 35977 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKSGVSNKDIEKETAKDSSGEPPSMTQLLRR

SEQ ID NO: 35978 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKSGVSNKDIEKETAKDSSSEPPSMTQLLRR

SEQ ID NO: 35979 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKSGVSNKDIEKETAKDSSAEPPSMTQLLRR

SEQ ID NO: 35980 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKSGVSNKDIEKETAKDSAGEPPSMTQLLRR

SEQ ID NO: 35981 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKSGVSNKDIEKETAKDSASEPPSMTQLLRR

SEQ ID NO: 35982 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKSGVSNKDIEKETAKDSAAEPPSMTQLLRR

SEQ ID NO: 35983 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKSGVSNKDIEKETAKDAGGEPPSMTQLLRR

SEQ ID NO: 35984 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKSGVSNKDIEKETAKDAGSEPPSMTQLLRR

SEQ ID NO: 35985 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKSGVSNKDIEKETAKDAGAEPPSMTQLLRR

SEQ ID NO: 35986 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKSGVSNKDIEKETAKDASGEPPSMTQLLRR

SEQ ID NO: 35987 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKSGVSNKDIEKETAKDASSEPPSMTQLLRR

SEQ ID NO: 35988 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKSGVSNKDIEKETAKDASAEPPSMTQLLRR

SEQ ID NO: 35989 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKSGVSNKDIEKETAKDAAGEPPSMTQLLRR

SEQ ID NO: 35990 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKSGVSNKDIEKETAKDAASEPPSMTQLLRR

SEQ ID NO: 35991 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKSGVSNKDIEKETAKDAAAEPPSMTQLLRR

SEQ ID NO: 35992 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKAGVSNKDIEKETAKDGGGEPPSMTQLLRR

SEQ ID NO: 35993 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKAGVSNKDIEKETAKDGGSEPPSMTQLLRR

SEQ ID NO: 35994 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKAGVSNKDIEKETAKDGGAEPPSMTQLLRR

SEQ ID NO: 35995 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKAGVSNKDIEKETAKDGSGEPPSMTQLLRR

SEQ ID NO: 35996 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKAGVSNKDIEKETAKDGSSEPPSMTQLLRR

SEQ ID NO: 35997 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKAGVSNKDIEKETAKDGSAEPPSMTQLLRR

SEQ ID NO: 35998 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKAGVSNKDIEKETAKDGAGEPPSMTQLLRR

SEQ ID NO: 35999 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKAGVSNKDIEKETAKDGASEPPSMTQLLRR

SEQ ID NO: 36000 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKAGVSNKDIEKETAKDGAAEPPSMTQLLRR

SEQ ID NO: 36001 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKAGVSNKDIEKETAKDSGGEPPSMTQLLRR

SEQ ID NO: 36002 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKAGVSNKDIEKETAKDSGSEPPSMTQLLRR

SEQ ID NO: 36003 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKAGVSNKDIEKETAKDSGAEPPSMTQLLRR

SEQ ID NO: 36004 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKAGVSNKDIEKETAKDSSGEPPSMTQLLRR

SEQ ID NO: 36005 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKAGVSNKDIEKETAKDSSSEPPSMTQLLRR

SEQ ID NO: 36006 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKAGVSNKDIEKETAKDSSAEPPSMTQLLRR

SEQ ID NO: 36007 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKAGVSNKDIEKETAKDSAGEPPSMTQLLRR

SEQ ID NO: 36008 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKAGVSNKDIEKETAKDSASEPPSMTQLLRR

SEQ ID NO: 36009 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKAGVSNKDIEKETAKDSAAEPPSMTQLLRR

SEQ ID NO: 36010 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKAGVSNKDIEKETAKDAGGEPPSMTQLLRR

SEQ ID NO: 36011 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKAGVSNKDIEKETAKDAGSEPPSMTQLLRR

SEQ ID NO: 36012 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKAGVSNKDIEKETAKDAGAEPPSMTQLLRR

SEQ ID NO: 36013 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKAGVSNKDIEKETAKDASGEPPSMTQLLRR

SEQ ID NO: 36014 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKAGVSNKDIEKETAKDASSEPPSMTQLLRR

SEQ ID NO: 36015 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKAGVSNKDIEKETAKDASAEPPSMTQLLRR

SEQ ID NO: 36016 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKAGVSNKDIEKETAKDAAGEPPSMTQLLRR

SEQ ID NO: 36017 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKAGVSNKDIEKETAKDAASEPPSMTQLLRR

SEQ ID NO: 36018 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKAGVSNKDIEKETAKDAAAEPPSMTQLLRR

SEQ ID NO: 36019 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKGGVSNKDIEKETAKDGGGEPPSMTQLLRR

SEQ ID NO: 36020 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKGGVSNKDIEKETAKDGGSEPPSMTQLLRR

SEQ ID NO: 36021 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKGGVSNKDIEKETAKDGGAEPPSMTQLLRR

SEQ ID NO: 36022 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKGGVSNKDIEKETAKDGSGEPPSMTQLLRR

SEQ ID NO: 36023 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKGGVSNKDIEKETAKDGSSEPPSMTQLLRR

SEQ ID NO: 36024 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKGGVSNKDIEKETAKDGSAEPPSMTQLLRR

SEQ ID NO: 36025 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKGGVSNKDIEKETAKDGAGEPPSMTQLLRR

SEQ ID NO: 36026 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKGGVSNKDIEKETAKDGASEPPSMTQLLRR

SEQ ID NO: 36027 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKGGVSNKDIEKETAKDGAAEPPSMTQLLRR

SEQ ID NO: 36028 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKGGVSNKDIEKETAKDSGGEPPSMTQLLRR

SEQ ID NO: 36029 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKGGVSNKDIEKETAKDSGSEPPSMTQLLRR

SEQ ID NO: 36030 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKGGVSNKDIEKETAKDSGAEPPSMTQLLRR

SEQ ID NO: 36031 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKGGVSNKDIEKETAKDSSGEPPSMTQLLRR

SEQ ID NO: 36032 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKGGVSNKDIEKETAKDSSSEPPSMTQLLRR

SEQ ID NO: 36033 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKGGVSNKDIEKETAKDSSAEPPSMTQLLRR

SEQ ID NO: 36034 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKGGVSNKDIEKETAKDSAGEPPSMTQLLRR

SEQ ID NO: 36035 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKGGVSNKDIEKETAKDSASEPPSMTQLLRR

SEQ ID NO: 36036 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKGGVSNKDIEKETAKDSAAEPPSMTQLLRR

SEQ ID NO: 36037 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKGGVSNKDIEKETAKDAGGEPPSMTQLLRR

SEQ ID NO: 36038 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKGGVSNKDIEKETAKDAGSEPPSMTQLLRR

SEQ ID NO: 36039 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKGGVSNKDIEKETAKDAGAEPPSMTQLLRR

SEQ ID NO: 36040 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKGGVSNKDIEKETAKDASGEPPSMTQLLRR

SEQ ID NO: 36041 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKGGVSNKDIEKETAKDASSEPPSMTQLLRR

SEQ ID NO: 36042 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKGGVSNKDIEKETAKDASAEPPSMTQLLRR

SEQ ID NO: 36043 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKGGVSNKDIEKETAKDAAGEPPSMTQLLRR

SEQ ID NO: 36044 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKGGVSNKDIEKETAKDAASEPPSMTQLLRR

SEQ ID NO: 36045 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKGGVSNKDIEKETAKDAAAEPPSMTQLLRR

SEQ ID NO: 36046 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKDGVSNKDIEKETAKDGGGEPPSMTQLLRR

SEQ ID NO: 36047 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKDGVSNKDIEKETAKDGGSEPPSMTQLLRR

SEQ ID NO: 36048 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKDGVSNKDIEKETAKDGGAEPPSMTQLLRR

SEQ ID NO: 36049 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKDGVSNKDIEKETAKDGSGEPPSMTQLLRR

SEQ ID NO: 36050 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKDGVSNKDIEKETAKDGSSEPPSMTQLLRR

SEQ ID NO: 36051 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKDGVSNKDIEKETAKDGSAEPPSMTQLLRR

SEQ ID NO: 36052 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKDGVSNKDIEKETAKDGAGEPPSMTQLLRR

SEQ ID NO: 36053 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKDGVSNKDIEKETAKDGASEPPSMTQLLRR

SEQ ID NO: 36054 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKDGVSNKDIEKETAKDGAAEPPSMTQLLRR

SEQ ID NO: 36055 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKDGVSNKDIEKETAKDSGGEPPSMTQLLRR

SEQ ID NO: 36056 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKDGVSNKDIEKETAKDSGSEPPSMTQLLRR

SEQ ID NO: 36057 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKDGVSNKDIEKETAKDSGAEPPSMTQLLRR

SEQ ID NO: 36058 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKDGVSNKDIEKETAKDSSGEPPSMTQLLRR

SEQ ID NO: 36059 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKDGVSNKDIEKETAKDSSSEPPSMTQLLRR

SEQ ID NO: 36060 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKDGVSNKDIEKETAKDSSAEPPSMTQLLRR

SEQ ID NO: 36061 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKDGVSNKDIEKETAKDSAGEPPSMTQLLRR

SEQ ID NO: 36062 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKDGVSNKDIEKETAKDSASEPPSMTQLLRR

SEQ ID NO: 36063 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKDGVSNKDIEKETAKDSAAEPPSMTQLLRR

SEQ ID NO: 36064 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKDGVSNKDIEKETAKDAGGEPPSMTQLLRR

SEQ ID NO: 36065 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKDGVSNKDIEKETAKDAGSEPPSMTQLLRR

SEQ ID NO: 36066 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKDGVSNKDIEKETAKDAGAEPPSMTQLLRR

SEQ ID NO: 36067 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKDGVSNKDIEKETAKDASGEPPSMTQLLRR

SEQ ID NO: 36068 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKDGVSNKDIEKETAKDASSEPPSMTQLLRR

SEQ ID NO: 36069 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKDGVSNKDIEKETAKDASAEPPSMTQLLRR

SEQ ID NO: 36070 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKDGVSNKDIEKETAKDAAGEPPSMTQLLRR

SEQ ID NO: 36071 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKDGVSNKDIEKETAKDAASEPPSMTQLLRR

SEQ ID NO: 36072 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKDGVSNKDIEKETAKDAAAEPPSMTQLLRR

SEQ ID NO: 36073 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKHGVSNKDIEKETAKDGGGEPPSMTQLLRR

SEQ ID NO: 36074 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKHGVSNKDIEKETAKDGGSEPPSMTQLLRR

SEQ ID NO: 36075 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKHGVSNKDIEKETAKDGGAEPPSMTQLLRR

SEQ ID NO: 36076 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKHGVSNKDIEKETAKDGSGEPPSMTQLLRR

SEQ ID NO: 36077 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKHGVSNKDIEKETAKDGSSEPPSMTQLLRR

SEQ ID NO: 36078 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKHGVSNKDIEKETAKDGSAEPPSMTQLLRR

SEQ ID NO: 36079 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKHGVSNKDIEKETAKDGAGEPPSMTQLLRR

SEQ ID NO: 36080 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKHGVSNKDIEKETAKDGASEPPSMTQLLRR

SEQ ID NO: 36081 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKHGVSNKDIEKETAKDGAAEPPSMTQLLRR

SEQ ID NO: 36082 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKHGVSNKDIEKETAKDSGGEPPSMTQLLRR

SEQ ID NO: 36083 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKHGVSNKDIEKETAKDSGSEPPSMTQLLRR

SEQ ID NO: 36084 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKHGVSNKDIEKETAKDSGAEPPSMTQLLRR

SEQ ID NO: 36085 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKHGVSNKDIEKETAKDSSGEPPSMTQLLRR

SEQ ID NO: 36086 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKHGVSNKDIEKETAKDSSSEPPSMTQLLRR

SEQ ID NO: 36087 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKHGVSNKDIEKETAKDSSAEPPSMTQLLRR

SEQ ID NO: 36088 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKHGVSNKDIEKETAKDSAGEPPSMTQLLRR

SEQ ID NO: 36089 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKHGVSNKDIEKETAKDSASEPPSMTQLLRR

SEQ ID NO: 36090 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKHGVSNKDIEKETAKDSAAEPPSMTQLLRR

SEQ ID NO: 36091 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKHGVSNKDIEKETAKDAGGEPPSMTQLLRR

SEQ ID NO: 36092 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKHGVSNKDIEKETAKDAGSEPPSMTQLLRR

SEQ ID NO: 36093 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKHGVSNKDIEKETAKDAGAEPPSMTQLLRR

SEQ ID NO: 36094 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKHGVSNKDIEKETAKDASGEPPSMTQLLRR

SEQ ID NO: 36095 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKHGVSNKDIEKETAKDASSEPPSMTQLLRR

SEQ ID NO: 36096 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKHGVSNKDIEKETAKDASAEPPSMTQLLRR

SEQ ID NO: 36097 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKHGVSNKDIEKETAKDAAGEPPSMTQLLRR

SEQ ID NO: 36098 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKHGVSNKDIEKETAKDAASEPPSMTQLLRR

SEQ ID NO: 36099 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKHGVSNKDIEKETAKDAAAEPPSMTQLLRR

SEQ ID NO: 36100 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKYGVSNKDIEKETAKDGGGEPPSMTQLLRR

SEQ ID NO: 36101 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKYGVSNKDIEKETAKDGGSEPPSMTQLLRR

SEQ ID NO: 36102 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKYGVSNKDIEKETAKDGGAEPPSMTQLLRR

SEQ ID NO: 36103 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKYGVSNKDIEKETAKDGSGEPPSMTQLLRR

SEQ ID NO: 36104 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKYGVSNKDIEKETAKDGSSEPPSMTQLLRR

SEQ ID NO: 36105 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKYGVSNKDIEKETAKDGSAEPPSMTQLLRR

SEQ ID NO: 36106 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKYGVSNKDIEKETAKDGAGEPPSMTQLLRR

SEQ ID NO: 36107 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKYGVSNKDIEKETAKDGASEPPSMTQLLRR

SEQ ID NO: 36108 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKYGVSNKDIEKETAKDGAAEPPSMTQLLRR

SEQ ID NO: 36109 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKYGVSNKDIEKETAKDSGGEPPSMTQLLRR

SEQ ID NO: 36110 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKYGVSNKDIEKETAKDSGSEPPSMTQLLRR

SEQ ID NO: 36111 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKYGVSNKDIEKETAKDSGAEPPSMTQLLRR

SEQ ID NO: 36112 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKYGVSNKDIEKETAKDSSGEPPSMTQLLRR

SEQ ID NO: 36113 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKYGVSNKDIEKETAKDSSSEPPSMTQLLRR

SEQ ID NO: 36114 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKYGVSNKDIEKETAKDSSAEPPSMTQLLRR

SEQ ID NO: 36115 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKYGVSNKDIEKETAKDSAGEPPSMTQLLRR

SEQ ID NO: 36116 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKYGVSNKDIEKETAKDSASEPPSMTQLLRR

SEQ ID NO: 36117 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKYGVSNKDIEKETAKDSAAEPPSMTQLLRR

SEQ ID NO: 36118 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKYGVSNKDIEKETAKDAGGEPPSMTQLLRR

SEQ ID NO: 36119 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKYGVSNKDIEKETAKDAGSEPPSMTQLLRR

SEQ ID NO: 36120 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKYGVSNKDIEKETAKDAGAEPPSMTQLLRR

SEQ ID NO: 36121 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKYGVSNKDIEKETAKDASGEPPSMTQLLRR

SEQ ID NO: 36122 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKYGVSNKDIEKETAKDASSEPPSMTQLLRR

SEQ ID NO: 36123 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKYGVSNKDIEKETAKDASAEPPSMTQLLRR

SEQ ID NO: 36124 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKYGVSNKDIEKETAKDAAGEPPSMTQLLRR

SEQ ID NO: 36125 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKYGVSNKDIEKETAKDAASEPPSMTQLLRR

SEQ ID NO: 36126 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKYGVSNKDIEKETAKDAAAEPPSMTQLLRR

SEQ ID NO: 36127 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKKGVSNKDIEKETAKDGGGEPPSMTQLLRR

SEQ ID NO: 36128 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKKGVSNKDIEKETAKDGGSEPPSMTQLLRR

SEQ ID NO: 36129 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKKGVSNKDIEKETAKDGGAEPPSMTQLLRR

SEQ ID NO: 36130 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKKGVSNKDIEKETAKDGSGEPPSMTQLLRR

SEQ ID NO: 36131 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKKGVSNKDIEKETAKDGSSEPPSMTQLLRR

SEQ ID NO: 36132 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKKGVSNKDIEKETAKDGSAEPPSMTQLLRR

SEQ ID NO: 36133 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKKGVSNKDIEKETAKDGAGEPPSMTQLLRR

SEQ ID NO: 36134 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKKGVSNKDIEKETAKDGASEPPSMTQLLRR

SEQ ID NO: 36135 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKKGVSNKDIEKETAKDGAAEPPSMTQLLRR

SEQ ID NO: 36136 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKKGVSNKDIEKETAKDSGGEPPSMTQLLRR

SEQ ID NO: 36137 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKKGVSNKDIEKETAKDSGSEPPSMTQLLRR

SEQ ID NO: 36138 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKKGVSNKDIEKETAKDSGAEPPSMTQLLRR

SEQ ID NO: 36139 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKKGVSNKDIEKETAKDSSGEPPSMTQLLRR

SEQ ID NO: 36140 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKKGVSNKDIEKETAKDSSSEPPSMTQLLRR

SEQ ID NO: 36141 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKKGVSNKDIEKETAKDSSAEPPSMTQLLRR

SEQ ID NO: 36142 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKKGVSNKDIEKETAKDSAGEPPSMTQLLRR

SEQ ID NO: 36143 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKKGVSNKDIEKETAKDSASEPPSMTQLLRR

SEQ ID NO: 36144 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKKGVSNKDIEKETAKDSAAEPPSMTQLLRR

SEQ ID NO: 36145 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKKGVSNKDIEKETAKDAGGEPPSMTQLLRR

SEQ ID NO: 36146 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKKGVSNKDIEKETAKDAGSEPPSMTQLLRR

SEQ ID NO: 36147 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKKGVSNKDIEKETAKDAGAEPPSMTQLLRR

SEQ ID NO: 36148 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKKGVSNKDIEKETAKDASGEPPSMTQLLRR

SEQ ID NO: 36149 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKKGVSNKDIEKETAKDASSEPPSMTQLLRR

SEQ ID NO: 36150 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKKGVSNKDIEKETAKDASAEPPSMTQLLRR

SEQ ID NO: 36151 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKKGVSNKDIEKETAKDAAGEPPSMTQLLRR

SEQ ID NO: 36152 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKKGVSNKDIEKETAKDAASEPPSMTQLLRR

SEQ ID NO: 36153 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKKGVSNKDIEKETAKDAAAEPPSMTQLLRR

SEQ ID NO: 36154 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKNGVSNKDIEKETAKDGGGEPPSMTQLLRR

SEQ ID NO: 36155 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKNGVSNKDIEKETAKDGGSEPPSMTQLLRR

SEQ ID NO: 36156 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKNGVSNKDIEKETAKDGGAEPPSMTQLLRR

SEQ ID NO: 36157 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKNGVSNKDIEKETAKDGSGEPPSMTQLLRR

SEQ ID NO: 36158 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKNGVSNKDIEKETAKDGSSEPPSMTQLLRR

SEQ ID NO: 36159 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKNGVSNKDIEKETAKDGSAEPPSMTQLLRR

SEQ ID NO: 36160 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKNGVSNKDIEKETAKDGAGEPPSMTQLLRR

SEQ ID NO: 36161 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKNGVSNKDIEKETAKDGASEPPSMTQLLRR

SEQ ID NO: 36162 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKNGVSNKDIEKETAKDGAAEPPSMTQLLRR

SEQ ID NO: 36163 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKNGVSNKDIEKETAKDSGGEPPSMTQLLRR

SEQ ID NO: 36164 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKNGVSNKDIEKETAKDSGSEPPSMTQLLRR

SEQ ID NO: 36165 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKNGVSNKDIEKETAKDSGAEPPSMTQLLRR

SEQ ID NO: 36166 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKNGVSNKDIEKETAKDSSGEPPSMTQLLRR

SEQ ID NO: 36167 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKNGVSNKDIEKETAKDSSSEPPSMTQLLRR

SEQ ID NO: 36168 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKNGVSNKDIEKETAKDSSAEPPSMTQLLRR

SEQ ID NO: 36169 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKNGVSNKDIEKETAKDSAGEPPSMTQLLRR

SEQ ID NO: 36170 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKNGVSNKDIEKETAKDSASEPPSMTQLLRR

SEQ ID NO: 36171 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKNGVSNKDIEKETAKDSAAEPPSMTQLLRR

SEQ ID NO: 36172 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKNGVSNKDIEKETAKDAGGEPPSMTQLLRR

SEQ ID NO: 36173 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKNGVSNKDIEKETAKDAGSEPPSMTQLLRR

SEQ ID NO: 36174 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKNGVSNKDIEKETAKDAGAEPPSMTQLLRR

SEQ ID NO: 36175 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKNGVSNKDIEKETAKDASGEPPSMTQLLRR

SEQ ID NO: 36176 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKNGVSNKDIEKETAKDASSEPPSMTQLLRR

SEQ ID NO: 36177 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKNGVSNKDIEKETAKDASAEPPSMTQLLRR

SEQ ID NO: 36178 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKNGVSNKDIEKETAKDAAGEPPSMTQLLRR

SEQ ID NO: 36179 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKNGVSNKDIEKETAKDAASEPPSMTQLLRR

SEQ ID NO: 36180 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKNGVSNKDIEKETAKDAAAEPPSMTQLLRR

SEQ ID NO: 36181 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKMGVSNKDIEKETAKDGGGEPPSMTQLLRR

SEQ ID NO: 36182 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKMGVSNKDIEKETAKDGGSEPPSMTQLLRR

SEQ ID NO: 36183 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKMGVSNKDIEKETAKDGGAEPPSMTQLLRR

SEQ ID NO: 36184 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKMGVSNKDIEKETAKDGSGEPPSMTQLLRR

SEQ ID NO: 36185 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKMGVSNKDIEKETAKDGSSEPPSMTQLLRR

SEQ ID NO: 36186 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKMGVSNKDIEKETAKDGSAEPPSMTQLLRR

SEQ ID NO: 36187 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKMGVSNKDIEKETAKDGAGEPPSMTQLLRR

SEQ ID NO: 36188 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKMGVSNKDIEKETAKDGASEPPSMTQLLRR

SEQ ID NO: 36189 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKMGVSNKDIEKETAKDGAAEPPSMTQLLRR

SEQ ID NO: 36190 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKMGVSNKDIEKETAKDSGGEPPSMTQLLRR

SEQ ID NO: 36191 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKMGVSNKDIEKETAKDSGSEPPSMTQLLRR

SEQ ID NO: 36192 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKMGVSNKDIEKETAKDSGAEPPSMTQLLRR

SEQ ID NO: 36193 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKMGVSNKDIEKETAKDSSGEPPSMTQLLRR

SEQ ID NO: 36194 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKMGVSNKDIEKETAKDSSSEPPSMTQLLRR

SEQ ID NO: 36195 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKMGVSNKDIEKETAKDSSAEPPSMTQLLRR

SEQ ID NO: 36196 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKMGVSNKDIEKETAKDSAGEPPSMTQLLRR

SEQ ID NO: 36197 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKMGVSNKDIEKETAKDSASEPPSMTQLLRR

SEQ ID NO: 36198 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKMGVSNKDIEKETAKDSAAEPPSMTQLLRR

SEQ ID NO: 36199 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKMGVSNKDIEKETAKDAGGEPPSMTQLLRR

SEQ ID NO: 36200 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKMGVSNKDIEKETAKDAGSEPPSMTQLLRR

SEQ ID NO: 36201 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKMGVSNKDIEKETAKDAGAEPPSMTQLLRR

SEQ ID NO: 36202 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKMGVSNKDIEKETAKDASGEPPSMTQLLRR

SEQ ID NO: 36203 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKMGVSNKDIEKETAKDASSEPPSMTQLLRR

SEQ ID NO: 36204 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKMGVSNKDIEKETAKDASAEPPSMTQLLRR

SEQ ID NO: 36205 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKMGVSNKDIEKETAKDAAGEPPSMTQLLRR

SEQ ID NO: 36206 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKMGVSNKDIEKETAKDAASEPPSMTQLLRR

SEQ ID NO: 36207 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKMGVSNKDIEKETAKDAAAEPPSMTQLLRR

SEQ ID NO: 36208 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKCGVSNKDIEKETAKDGGGEPPSMTQLLRR

SEQ ID NO: 36209 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKCGVSNKDIEKETAKDGGSEPPSMTQLLRR

SEQ ID NO: 36210 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKCGVSNKDIEKETAKDGGAEPPSMTQLLRR

SEQ ID NO: 36211 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKCGVSNKDIEKETAKDGSGEPPSMTQLLRR

SEQ ID NO: 36212 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKCGVSNKDIEKETAKDGSSEPPSMTQLLRR

SEQ ID NO: 36213 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKCGVSNKDIEKETAKDGSAEPPSMTQLLRR

SEQ ID NO: 36214 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKCGVSNKDIEKETAKDGAGEPPSMTQLLRR

SEQ ID NO: 36215 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKCGVSNKDIEKETAKDGASEPPSMTQLLRR

SEQ ID NO: 36216 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKCGVSNKDIEKETAKDGAAEPPSMTQLLRR

SEQ ID NO: 36217 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKCGVSNKDIEKETAKDSGGEPPSMTQLLRR

SEQ ID NO: 36218 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKCGVSNKDIEKETAKDSGSEPPSMTQLLRR

SEQ ID NO: 36219 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKCGVSNKDIEKETAKDSGAEPPSMTQLLRR

SEQ ID NO: 36220 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKCGVSNKDIEKETAKDSSGEPPSMTQLLRR

SEQ ID NO: 36221 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKCGVSNKDIEKETAKDSSSEPPSMTQLLRR

SEQ ID NO: 36222 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKCGVSNKDIEKETAKDSSAEPPSMTQLLRR

SEQ ID NO: 36223 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKCGVSNKDIEKETAKDSAGEPPSMTQLLRR

SEQ ID NO: 36224 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKCGVSNKDIEKETAKDSASEPPSMTQLLRR

SEQ ID NO: 36225 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKCGVSNKDIEKETAKDSAAEPPSMTQLLRR

SEQ ID NO: 36226 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKCGVSNKDIEKETAKDAGGEPPSMTQLLRR

SEQ ID NO: 36227 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKCGVSNKDIEKETAKDAGSEPPSMTQLLRR

SEQ ID NO: 36228 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKCGVSNKDIEKETAKDAGAEPPSMTQLLRR

SEQ ID NO: 36229 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKCGVSNKDIEKETAKDASGEPPSMTQLLRR

SEQ ID NO: 36230 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKCGVSNKDIEKETAKDASSEPPSMTQLLRR

SEQ ID NO: 36231 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKCGVSNKDIEKETAKDASAEPPSMTQLLRR

SEQ ID NO: 36232 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKCGVSNKDIEKETAKDAAGEPPSMTQLLRR

SEQ ID NO: 36233 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKCGVSNKDIEKETAKDAASEPPSMTQLLRR

SEQ ID NO: 36234 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKCGVSNKDIEKETAKDAAAEPPSMTQLLRR

SEQ ID NO: 36235 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKSGVSNKDIEKETAKDGGGEPPSMTQLLRR

SEQ ID NO: 36236 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKSGVSNKDIEKETAKDGGSEPPSMTQLLRR

SEQ ID NO: 36237 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKSGVSNKDIEKETAKDGGAEPPSMTQLLRR

SEQ ID NO: 36238 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKSGVSNKDIEKETAKDGSGEPPSMTQLLRR

SEQ ID NO: 36239 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKSGVSNKDIEKETAKDGSSEPPSMTQLLRR

SEQ ID NO: 36240 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKSGVSNKDIEKETAKDGSAEPPSMTQLLRR

SEQ ID NO: 36241 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKSGVSNKDIEKETAKDGAGEPPSMTQLLRR

SEQ ID NO: 36242 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKSGVSNKDIEKETAKDGASEPPSMTQLLRR

SEQ ID NO: 36243 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKSGVSNKDIEKETAKDGAAEPPSMTQLLRR

SEQ ID NO: 36244 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKSGVSNKDIEKETAKDSGGEPPSMTQLLRR

SEQ ID NO: 36245 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKSGVSNKDIEKETAKDSGSEPPSMTQLLRR

SEQ ID NO: 36246 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKSGVSNKDIEKETAKDSGAEPPSMTQLLRR

SEQ ID NO: 36247 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKSGVSNKDIEKETAKDSSGEPPSMTQLLRR

SEQ ID NO: 36248 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKSGVSNKDIEKETAKDSSSEPPSMTQLLRR

SEQ ID NO: 36249 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKSGVSNKDIEKETAKDSSAEPPSMTQLLRR

SEQ ID NO: 36250 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKSGVSNKDIEKETAKDSAGEPPSMTQLLRR

SEQ ID NO: 36251 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKSGVSNKDIEKETAKDSASEPPSMTQLLRR

SEQ ID NO: 36252 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKSGVSNKDIEKETAKDSAAEPPSMTQLLRR

SEQ ID NO: 36253 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKSGVSNKDIEKETAKDAGGEPPSMTQLLRR

SEQ ID NO: 36254 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKSGVSNKDIEKETAKDAGSEPPSMTQLLRR

SEQ ID NO: 36255 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKSGVSNKDIEKETAKDAGAEPPSMTQLLRR

SEQ ID NO: 36256 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKSGVSNKDIEKETAKDASGEPPSMTQLLRR

SEQ ID NO: 36257 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKSGVSNKDIEKETAKDASSEPPSMTQLLRR

SEQ ID NO: 36258 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKSGVSNKDIEKETAKDASAEPPSMTQLLRR

SEQ ID NO: 36259 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKSGVSNKDIEKETAKDAAGEPPSMTQLLRR

SEQ ID NO: 36260 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKSGVSNKDIEKETAKDAASEPPSMTQLLRR

SEQ ID NO: 36261 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKSGVSNKDIEKETAKDAAAEPPSMTQLLRR

SEQ ID NO: 36262 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKAGVSNKDIEKETAKDGGGEPPSMTQLLRR

SEQ ID NO: 36263 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKAGVSNKDIEKETAKDGGSEPPSMTQLLRR

SEQ ID NO: 36264 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKAGVSNKDIEKETAKDGGAEPPSMTQLLRR

SEQ ID NO: 36265 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKAGVSNKDIEKETAKDGSGEPPSMTQLLRR

SEQ ID NO: 36266 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKAGVSNKDIEKETAKDGSSEPPSMTQLLRR

SEQ ID NO: 36267 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKAGVSNKDIEKETAKDGSAEPPSMTQLLRR

SEQ ID NO: 36268 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKAGVSNKDIEKETAKDGAGEPPSMTQLLRR

SEQ ID NO: 36269 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKAGVSNKDIEKETAKDGASEPPSMTQLLRR

SEQ ID NO: 36270 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKAGVSNKDIEKETAKDGAAEPPSMTQLLRR

SEQ ID NO: 36271 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKAGVSNKDIEKETAKDSGGEPPSMTQLLRR

SEQ ID NO: 36272 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKAGVSNKDIEKETAKDSGSEPPSMTQLLRR

SEQ ID NO: 36273 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKAGVSNKDIEKETAKDSGAEPPSMTQLLRR

SEQ ID NO: 36274 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKAGVSNKDIEKETAKDSSGEPPSMTQLLRR

SEQ ID NO: 36275 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKAGVSNKDIEKETAKDSSSEPPSMTQLLRR

SEQ ID NO: 36276 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKAGVSNKDIEKETAKDSSAEPPSMTQLLRR

SEQ ID NO: 36277 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKAGVSNKDIEKETAKDSAGEPPSMTQLLRR

SEQ ID NO: 36278 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKAGVSNKDIEKETAKDSASEPPSMTQLLRR

SEQ ID NO: 36279 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKAGVSNKDIEKETAKDSAAEPPSMTQLLRR

SEQ ID NO: 36280 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKAGVSNKDIEKETAKDAGGEPPSMTQLLRR

SEQ ID NO: 36281 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKAGVSNKDIEKETAKDAGSEPPSMTQLLRR

SEQ ID NO: 36282 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKAGVSNKDIEKETAKDAGAEPPSMTQLLRR

SEQ ID NO: 36283 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKAGVSNKDIEKETAKDASGEPPSMTQLLRR

SEQ ID NO: 36284 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKAGVSNKDIEKETAKDASSEPPSMTQLLRR

SEQ ID NO: 36285 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKAGVSNKDIEKETAKDASAEPPSMTQLLRR

SEQ ID NO: 36286 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKAGVSNKDIEKETAKDAAGEPPSMTQLLRR

SEQ ID NO: 36287 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKAGVSNKDIEKETAKDAASEPPSMTQLLRR

SEQ ID NO: 36288 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKAGVSNKDIEKETAKDAAAEPPSMTQLLRR

SEQ ID NO: 36289 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKGGVSNKDIEKETAKDGGGEPPSMTQLLRR

SEQ ID NO: 36290 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKGGVSNKDIEKETAKDGGSEPPSMTQLLRR

SEQ ID NO: 36291 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKGGVSNKDIEKETAKDGGAEPPSMTQLLRR

SEQ ID NO: 36292 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKGGVSNKDIEKETAKDGSGEPPSMTQLLRR

SEQ ID NO: 36293 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKGGVSNKDIEKETAKDGSSEPPSMTQLLRR

SEQ ID NO: 36294 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKGGVSNKDIEKETAKDGSAEPPSMTQLLRR

SEQ ID NO: 36295 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKGGVSNKDIEKETAKDGAGEPPSMTQLLRR

SEQ ID NO: 36296 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKGGVSNKDIEKETAKDGASEPPSMTQLLRR

SEQ ID NO: 36297 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKGGVSNKDIEKETAKDGAAEPPSMTQLLRR

SEQ ID NO: 36298 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKGGVSNKDIEKETAKDSGGEPPSMTQLLRR

SEQ ID NO: 36299 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKGGVSNKDIEKETAKDSGSEPPSMTQLLRR

SEQ ID NO: 36300 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKGGVSNKDIEKETAKDSGAEPPSMTQLLRR

SEQ ID NO: 36301 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKGGVSNKDIEKETAKDSSGEPPSMTQLLRR

SEQ ID NO: 36302 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKGGVSNKDIEKETAKDSSSEPPSMTQLLRR

SEQ ID NO: 36303 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKGGVSNKDIEKETAKDSSAEPPSMTQLLRR

SEQ ID NO: 36304 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKGGVSNKDIEKETAKDSAGEPPSMTQLLRR

SEQ ID NO: 36305 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKGGVSNKDIEKETAKDSASEPPSMTQLLRR

SEQ ID NO: 36306 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKGGVSNKDIEKETAKDSAAEPPSMTQLLRR

SEQ ID NO: 36307 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKGGVSNKDIEKETAKDAGGEPPSMTQLLRR

SEQ ID NO: 36308 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKGGVSNKDIEKETAKDAGSEPPSMTQLLRR

SEQ ID NO: 36309 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKGGVSNKDIEKETAKDAGAEPPSMTQLLRR

SEQ ID NO: 36310 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKGGVSNKDIEKETAKDASGEPPSMTQLLRR

SEQ ID NO: 36311 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKGGVSNKDIEKETAKDASSEPPSMTQLLRR

SEQ ID NO: 36312 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKGGVSNKDIEKETAKDASAEPPSMTQLLRR

SEQ ID NO: 36313 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKGGVSNKDIEKETAKDAAGEPPSMTQLLRR

SEQ ID NO: 36314 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKGGVSNKDIEKETAKDAASEPPSMTQLLRR

SEQ ID NO: 36315 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKGGVSNKDIEKETAKDAAAEPPSMTQLLRR

SEQ ID NO: 36316 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKDGVSNKDIEKETAKDGGGEPPSMTQLLRR

SEQ ID NO: 36317 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKDGVSNKDIEKETAKDGGSEPPSMTQLLRR

SEQ ID NO: 36318 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKDGVSNKDIEKETAKDGGAEPPSMTQLLRR

SEQ ID NO: 36319 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKDGVSNKDIEKETAKDGSGEPPSMTQLLRR

SEQ ID NO: 36320 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKDGVSNKDIEKETAKDGSSEPPSMTQLLRR

SEQ ID NO: 36321 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKDGVSNKDIEKETAKDGSAEPPSMTQLLRR

SEQ ID NO: 36322 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKDGVSNKDIEKETAKDGAGEPPSMTQLLRR

SEQ ID NO: 36323 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKDGVSNKDIEKETAKDGASEPPSMTQLLRR

SEQ ID NO: 36324 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKDGVSNKDIEKETAKDGAAEPPSMTQLLRR

SEQ ID NO: 36325 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKDGVSNKDIEKETAKDSGGEPPSMTQLLRR

SEQ ID NO: 36326 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKDGVSNKDIEKETAKDSGSEPPSMTQLLRR

SEQ ID NO: 36327 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKDGVSNKDIEKETAKDSGAEPPSMTQLLRR

SEQ ID NO: 36328 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKDGVSNKDIEKETAKDSSGEPPSMTQLLRR

SEQ ID NO: 36329 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKDGVSNKDIEKETAKDSSSEPPSMTQLLRR

SEQ ID NO: 36330 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKDGVSNKDIEKETAKDSSAEPPSMTQLLRR

SEQ ID NO: 36331 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKDGVSNKDIEKETAKDSAGEPPSMTQLLRR

SEQ ID NO: 36332 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKDGVSNKDIEKETAKDSASEPPSMTQLLRR

SEQ ID NO: 36333 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKDGVSNKDIEKETAKDSAAEPPSMTQLLRR

SEQ ID NO: 36334 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKDGVSNKDIEKETAKDAGGEPPSMTQLLRR

SEQ ID NO: 36335 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKDGVSNKDIEKETAKDAGSEPPSMTQLLRR

SEQ ID NO: 36336 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKDGVSNKDIEKETAKDAGAEPPSMTQLLRR

SEQ ID NO: 36337 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKDGVSNKDIEKETAKDASGEPPSMTQLLRR

SEQ ID NO: 36338 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKDGVSNKDIEKETAKDASSEPPSMTQLLRR

SEQ ID NO: 36339 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKDGVSNKDIEKETAKDASAEPPSMTQLLRR

SEQ ID NO: 36340 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKDGVSNKDIEKETAKDAAGEPPSMTQLLRR

SEQ ID NO: 36341 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKDGVSNKDIEKETAKDAASEPPSMTQLLRR

SEQ ID NO: 36342 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKDGVSNKDIEKETAKDAAAEPPSMTQLLRR

SEQ ID NO: 36343 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKHGVSNKDIEKETAKDGGGEPPSMTQLLRR

SEQ ID NO: 36344 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKHGVSNKDIEKETAKDGGSEPPSMTQLLRR

SEQ ID NO: 36345 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKHGVSNKDIEKETAKDGGAEPPSMTQLLRR

SEQ ID NO: 36346 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKHGVSNKDIEKETAKDGSGEPPSMTQLLRR

SEQ ID NO: 36347 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKHGVSNKDIEKETAKDGSSEPPSMTQLLRR

SEQ ID NO: 36348 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKHGVSNKDIEKETAKDGSAEPPSMTQLLRR

SEQ ID NO: 36349 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKHGVSNKDIEKETAKDGAGEPPSMTQLLRR

SEQ ID NO: 36350 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKHGVSNKDIEKETAKDGASEPPSMTQLLRR

SEQ ID NO: 36351 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKHGVSNKDIEKETAKDGAAEPPSMTQLLRR

SEQ ID NO: 36352 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKHGVSNKDIEKETAKDSGGEPPSMTQLLRR

SEQ ID NO: 36353 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKHGVSNKDIEKETAKDSGSEPPSMTQLLRR

SEQ ID NO: 36354 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKHGVSNKDIEKETAKDSGAEPPSMTQLLRR

SEQ ID NO: 36355 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKHGVSNKDIEKETAKDSSGEPPSMTQLLRR

SEQ ID NO: 36356 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKHGVSNKDIEKETAKDSSSEPPSMTQLLRR

SEQ ID NO: 36357 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKHGVSNKDIEKETAKDSSAEPPSMTQLLRR

SEQ ID NO: 36358 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKHGVSNKDIEKETAKDSAGEPPSMTQLLRR

SEQ ID NO: 36359 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKHGVSNKDIEKETAKDSASEPPSMTQLLRR

SEQ ID NO: 36360 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKHGVSNKDIEKETAKDSAAEPPSMTQLLRR

SEQ ID NO: 36361 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKHGVSNKDIEKETAKDAGGEPPSMTQLLRR

SEQ ID NO: 36362 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKHGVSNKDIEKETAKDAGSEPPSMTQLLRR

SEQ ID NO: 36363 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKHGVSNKDIEKETAKDAGAEPPSMTQLLRR

SEQ ID NO: 36364 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKHGVSNKDIEKETAKDASGEPPSMTQLLRR

SEQ ID NO: 36365 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKHGVSNKDIEKETAKDASSEPPSMTQLLRR

SEQ ID NO: 36366 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKHGVSNKDIEKETAKDASAEPPSMTQLLRR

SEQ ID NO: 36367 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKHGVSNKDIEKETAKDAAGEPPSMTQLLRR

SEQ ID NO: 36368 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKHGVSNKDIEKETAKDAASEPPSMTQLLRR

SEQ ID NO: 36369 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKHGVSNKDIEKETAKDAAAEPPSMTQLLRR

SEQ ID NO: 36370 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKYGVSNKDIEKETAKDGGGEPPSMTQLLRR

SEQ ID NO: 36371 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKYGVSNKDIEKETAKDGGSEPPSMTQLLRR

SEQ ID NO: 36372 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKYGVSNKDIEKETAKDGGAEPPSMTQLLRR

SEQ ID NO: 36373 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKYGVSNKDIEKETAKDGSGEPPSMTQLLRR

SEQ ID NO: 36374 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKYGVSNKDIEKETAKDGSSEPPSMTQLLRR

SEQ ID NO: 36375 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKYGVSNKDIEKETAKDGSAEPPSMTQLLRR

SEQ ID NO: 36376 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKYGVSNKDIEKETAKDGAGEPPSMTQLLRR

SEQ ID NO: 36377 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKYGVSNKDIEKETAKDGASEPPSMTQLLRR

SEQ ID NO: 36378 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKYGVSNKDIEKETAKDGAAEPPSMTQLLRR

SEQ ID NO: 36379 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKYGVSNKDIEKETAKDSGGEPPSMTQLLRR

SEQ ID NO: 36380 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKYGVSNKDIEKETAKDSGSEPPSMTQLLRR

SEQ ID NO: 36381 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKYGVSNKDIEKETAKDSGAEPPSMTQLLRR

SEQ ID NO: 36382 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKYGVSNKDIEKETAKDSSGEPPSMTQLLRR

SEQ ID NO: 36383 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKYGVSNKDIEKETAKDSSSEPPSMTQLLRR

SEQ ID NO: 36384 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKYGVSNKDIEKETAKDSSAEPPSMTQLLRR

SEQ ID NO: 36385 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKYGVSNKDIEKETAKDSAGEPPSMTQLLRR

SEQ ID NO: 36386 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKYGVSNKDIEKETAKDSASEPPSMTQLLRR

SEQ ID NO: 36387 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKYGVSNKDIEKETAKDSAAEPPSMTQLLRR

SEQ ID NO: 36388 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKYGVSNKDIEKETAKDAGGEPPSMTQLLRR

SEQ ID NO: 36389 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKYGVSNKDIEKETAKDAGSEPPSMTQLLRR

SEQ ID NO: 36390 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKYGVSNKDIEKETAKDAGAEPPSMTQLLRR

SEQ ID NO: 36391 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKYGVSNKDIEKETAKDASGEPPSMTQLLRR

SEQ ID NO: 36392 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKYGVSNKDIEKETAKDASSEPPSMTQLLRR

SEQ ID NO: 36393 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKYGVSNKDIEKETAKDASAEPPSMTQLLRR

SEQ ID NO: 36394 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKYGVSNKDIEKETAKDAAGEPPSMTQLLRR

SEQ ID NO: 36395 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKYGVSNKDIEKETAKDAASEPPSMTQLLRR

SEQ ID NO: 36396 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKYGVSNKDIEKETAKDAAAEPPSMTQLLRR

SEQ ID NO: 36397 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKKGVSNKDIEKETAKDGGGEPPSMTQLLRR

SEQ ID NO: 36398 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKKGVSNKDIEKETAKDGGSEPPSMTQLLRR

SEQ ID NO: 36399 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKKGVSNKDIEKETAKDGGAEPPSMTQLLRR

SEQ ID NO: 36400 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKKGVSNKDIEKETAKDGSGEPPSMTQLLRR

SEQ ID NO: 36401 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKKGVSNKDIEKETAKDGSSEPPSMTQLLRR

SEQ ID NO: 36402 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKKGVSNKDIEKETAKDGSAEPPSMTQLLRR

SEQ ID NO: 36403 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKKGVSNKDIEKETAKDGAGEPPSMTQLLRR

SEQ ID NO: 36404 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKKGVSNKDIEKETAKDGASEPPSMTQLLRR

SEQ ID NO: 36405 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKKGVSNKDIEKETAKDGAAEPPSMTQLLRR

SEQ ID NO: 36406 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKKGVSNKDIEKETAKDSGGEPPSMTQLLRR

SEQ ID NO: 36407 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKKGVSNKDIEKETAKDSGSEPPSMTQLLRR

SEQ ID NO: 36408 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKKGVSNKDIEKETAKDSGAEPPSMTQLLRR

SEQ ID NO: 36409 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKKGVSNKDIEKETAKDSSGEPPSMTQLLRR

SEQ ID NO: 36410 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKKGVSNKDIEKETAKDSSSEPPSMTQLLRR

SEQ ID NO: 36411 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKKGVSNKDIEKETAKDSSAEPPSMTQLLRR

SEQ ID NO: 36412 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKKGVSNKDIEKETAKDSAGEPPSMTQLLRR

SEQ ID NO: 36413 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKKGVSNKDIEKETAKDSASEPPSMTQLLRR

SEQ ID NO: 36414 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKKGVSNKDIEKETAKDSAAEPPSMTQLLRR

SEQ ID NO: 36415 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKKGVSNKDIEKETAKDAGGEPPSMTQLLRR

SEQ ID NO: 36416 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKKGVSNKDIEKETAKDAGSEPPSMTQLLRR

SEQ ID NO: 36417 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKKGVSNKDIEKETAKDAGAEPPSMTQLLRR

SEQ ID NO: 36418 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKKGVSNKDIEKETAKDASGEPPSMTQLLRR

SEQ ID NO: 36419 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKKGVSNKDIEKETAKDASSEPPSMTQLLRR

SEQ ID NO: 36420 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKKGVSNKDIEKETAKDASAEPPSMTQLLRR

SEQ ID NO: 36421 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKKGVSNKDIEKETAKDAAGEPPSMTQLLRR

SEQ ID NO: 36422 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKKGVSNKDIEKETAKDAASEPPSMTQLLRR

SEQ ID NO: 36423 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKKGVSNKDIEKETAKDAAAEPPSMTQLLRR

SEQ ID NO: 36424 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKNGVSNKDIEKETAKDGGGEPPSMTQLLRR

SEQ ID NO: 36425 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKNGVSNKDIEKETAKDGGSEPPSMTQLLRR

SEQ ID NO: 36426 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKNGVSNKDIEKETAKDGGAEPPSMTQLLRR

SEQ ID NO: 36427 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKNGVSNKDIEKETAKDGSGEPPSMTQLLRR

SEQ ID NO: 36428 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKNGVSNKDIEKETAKDGSSEPPSMTQLLRR

SEQ ID NO: 36429 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKNGVSNKDIEKETAKDGSAEPPSMTQLLRR

SEQ ID NO: 36430 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKNGVSNKDIEKETAKDGAGEPPSMTQLLRR

SEQ ID NO: 36431 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKNGVSNKDIEKETAKDGASEPPSMTQLLRR

SEQ ID NO: 36432 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKNGVSNKDIEKETAKDGAAEPPSMTQLLRR

SEQ ID NO: 36433 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKNGVSNKDIEKETAKDSGGEPPSMTQLLRR

SEQ ID NO: 36434 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKNGVSNKDIEKETAKDSGSEPPSMTQLLRR

SEQ ID NO: 36435 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKNGVSNKDIEKETAKDSGAEPPSMTQLLRR

SEQ ID NO: 36436 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKNGVSNKDIEKETAKDSSGEPPSMTQLLRR

SEQ ID NO: 36437 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKNGVSNKDIEKETAKDSSSEPPSMTQLLRR

SEQ ID NO: 36438 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKNGVSNKDIEKETAKDSSAEPPSMTQLLRR

SEQ ID NO: 36439 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKNGVSNKDIEKETAKDSAGEPPSMTQLLRR

SEQ ID NO: 36440 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKNGVSNKDIEKETAKDSASEPPSMTQLLRR

SEQ ID NO: 36441 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKNGVSNKDIEKETAKDSAAEPPSMTQLLRR

SEQ ID NO: 36442 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKNGVSNKDIEKETAKDAGGEPPSMTQLLRR

SEQ ID NO: 36443 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKNGVSNKDIEKETAKDAGSEPPSMTQLLRR

SEQ ID NO: 36444 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKNGVSNKDIEKETAKDAGAEPPSMTQLLRR

SEQ ID NO: 36445 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKNGVSNKDIEKETAKDASGEPPSMTQLLRR

SEQ ID NO: 36446 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKNGVSNKDIEKETAKDASSEPPSMTQLLRR

SEQ ID NO: 36447 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKNGVSNKDIEKETAKDASAEPPSMTQLLRR

SEQ ID NO: 36448 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKNGVSNKDIEKETAKDAAGEPPSMTQLLRR

SEQ ID NO: 36449 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKNGVSNKDIEKETAKDAASEPPSMTQLLRR

SEQ ID NO: 36450 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKNGVSNKDIEKETAKDAAAEPPSMTQLLRR

SEQ ID NO: 36451 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKMGVSNKDIEKETAKDGGGEPPSMTQLLRR

SEQ ID NO: 36452 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKMGVSNKDIEKETAKDGGSEPPSMTQLLRR

SEQ ID NO: 36453 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKMGVSNKDIEKETAKDGGAEPPSMTQLLRR

SEQ ID NO: 36454 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKMGVSNKDIEKETAKDGSGEPPSMTQLLRR

SEQ ID NO: 36455 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKMGVSNKDIEKETAKDGSSEPPSMTQLLRR

SEQ ID NO: 36456 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKMGVSNKDIEKETAKDGSAEPPSMTQLLRR

SEQ ID NO: 36457 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKMGVSNKDIEKETAKDGAGEPPSMTQLLRR

SEQ ID NO: 36458 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKMGVSNKDIEKETAKDGASEPPSMTQLLRR

SEQ ID NO: 36459 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKMGVSNKDIEKETAKDGAAEPPSMTQLLRR

SEQ ID NO: 36460 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKMGVSNKDIEKETAKDSGGEPPSMTQLLRR

SEQ ID NO: 36461 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKMGVSNKDIEKETAKDSGSEPPSMTQLLRR

SEQ ID NO: 36462 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKMGVSNKDIEKETAKDSGAEPPSMTQLLRR

SEQ ID NO: 36463 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKMGVSNKDIEKETAKDSSGEPPSMTQLLRR

SEQ ID NO: 36464 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKMGVSNKDIEKETAKDSSSEPPSMTQLLRR

SEQ ID NO: 36465 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKMGVSNKDIEKETAKDSSAEPPSMTQLLRR

SEQ ID NO: 36466 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKMGVSNKDIEKETAKDSAGEPPSMTQLLRR

SEQ ID NO: 36467 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKMGVSNKDIEKETAKDSASEPPSMTQLLRR

SEQ ID NO: 36468 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKMGVSNKDIEKETAKDSAAEPPSMTQLLRR

SEQ ID NO: 36469 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKMGVSNKDIEKETAKDAGGEPPSMTQLLRR

SEQ ID NO: 36470 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKMGVSNKDIEKETAKDAGSEPPSMTQLLRR

SEQ ID NO: 36471 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKMGVSNKDIEKETAKDAGAEPPSMTQLLRR

SEQ ID NO: 36472 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKMGVSNKDIEKETAKDASGEPPSMTQLLRR

SEQ ID NO: 36473 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKMGVSNKDIEKETAKDASSEPPSMTQLLRR

SEQ ID NO: 36474 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKMGVSNKDIEKETAKDASAEPPSMTQLLRR

SEQ ID NO: 36475 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKMGVSNKDIEKETAKDAAGEPPSMTQLLRR

SEQ ID NO: 36476 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKMGVSNKDIEKETAKDAASEPPSMTQLLRR

SEQ ID NO: 36477 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKMGVSNKDIEKETAKDAAAEPPSMTQLLRR

SEQ ID NO: 36478 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKCGVSNKDIEKETAKDGGGEPPSMTQLLRR

SEQ ID NO: 36479 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKCGVSNKDIEKETAKDGGSEPPSMTQLLRR

SEQ ID NO: 36480 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKCGVSNKDIEKETAKDGGAEPPSMTQLLRR

SEQ ID NO: 36481 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKCGVSNKDIEKETAKDGSGEPPSMTQLLRR

SEQ ID NO: 36482 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKCGVSNKDIEKETAKDGSSEPPSMTQLLRR

SEQ ID NO: 36483 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKCGVSNKDIEKETAKDGSAEPPSMTQLLRR

SEQ ID NO: 36484 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKCGVSNKDIEKETAKDGAGEPPSMTQLLRR

SEQ ID NO: 36485 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKCGVSNKDIEKETAKDGASEPPSMTQLLRR

SEQ ID NO: 36486 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKCGVSNKDIEKETAKDGAAEPPSMTQLLRR

SEQ ID NO: 36487 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKCGVSNKDIEKETAKDSGGEPPSMTQLLRR

SEQ ID NO: 36488 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKCGVSNKDIEKETAKDSGSEPPSMTQLLRR

SEQ ID NO: 36489 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKCGVSNKDIEKETAKDSGAEPPSMTQLLRR

SEQ ID NO: 36490 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKCGVSNKDIEKETAKDSSGEPPSMTQLLRR

SEQ ID NO: 36491 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKCGVSNKDIEKETAKDSSSEPPSMTQLLRR

SEQ ID NO: 36492 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKCGVSNKDIEKETAKDSSAEPPSMTQLLRR

SEQ ID NO: 36493 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKCGVSNKDIEKETAKDSAGEPPSMTQLLRR

SEQ ID NO: 36494 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKCGVSNKDIEKETAKDSASEPPSMTQLLRR

SEQ ID NO: 36495 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKCGVSNKDIEKETAKDSAAEPPSMTQLLRR

SEQ ID NO: 36496 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKCGVSNKDIEKETAKDAGGEPPSMTQLLRR

SEQ ID NO: 36497 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKCGVSNKDIEKETAKDAGSEPPSMTQLLRR

SEQ ID NO: 36498 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKCGVSNKDIEKETAKDAGAEPPSMTQLLRR

SEQ ID NO: 36499 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKCGVSNKDIEKETAKDASGEPPSMTQLLRR

SEQ ID NO: 36500 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKCGVSNKDIEKETAKDASSEPPSMTQLLRR

SEQ ID NO: 36501 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKCGVSNKDIEKETAKDASAEPPSMTQLLRR

SEQ ID NO: 36502 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKCGVSNKDIEKETAKDAAGEPPSMTQLLRR

SEQ ID NO: 36503 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKCGVSNKDIEKETAKDAASEPPSMTQLLRR

SEQ ID NO: 36504 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKCGVSNKDIEKETAKDAAAEPPSMTQLLRR

SEQ ID NO: 36505 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKSGVSNKDIEKETAKDGGGEPPSMTQLLRR

SEQ ID NO: 36506 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKSGVSNKDIEKETAKDGGSEPPSMTQLLRR

SEQ ID NO: 36507 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKSGVSNKDIEKETAKDGGAEPPSMTQLLRR

SEQ ID NO: 36508 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKSGVSNKDIEKETAKDGSGEPPSMTQLLRR

SEQ ID NO: 36509 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKSGVSNKDIEKETAKDGSSEPPSMTQLLRR

SEQ ID NO: 36510 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKSGVSNKDIEKETAKDGSAEPPSMTQLLRR

SEQ ID NO: 36511 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKSGVSNKDIEKETAKDGAGEPPSMTQLLRR

SEQ ID NO: 36512 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKSGVSNKDIEKETAKDGASEPPSMTQLLRR

SEQ ID NO: 36513 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKSGVSNKDIEKETAKDGAAEPPSMTQLLRR

SEQ ID NO: 36514 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKSGVSNKDIEKETAKDSGGEPPSMTQLLRR

SEQ ID NO: 36515 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKSGVSNKDIEKETAKDSGSEPPSMTQLLRR

SEQ ID NO: 36516 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKSGVSNKDIEKETAKDSGAEPPSMTQLLRR

SEQ ID NO: 36517 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKSGVSNKDIEKETAKDSSGEPPSMTQLLRR

SEQ ID NO: 36518 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKSGVSNKDIEKETAKDSSSEPPSMTQLLRR

SEQ ID NO: 36519 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKSGVSNKDIEKETAKDSSAEPPSMTQLLRR

SEQ ID NO: 36520 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKSGVSNKDIEKETAKDSAGEPPSMTQLLRR

SEQ ID NO: 36521 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKSGVSNKDIEKETAKDSASEPPSMTQLLRR

SEQ ID NO: 36522 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKSGVSNKDIEKETAKDSAAEPPSMTQLLRR

SEQ ID NO: 36523 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKSGVSNKDIEKETAKDAGGEPPSMTQLLRR

SEQ ID NO: 36524 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKSGVSNKDIEKETAKDAGSEPPSMTQLLRR

SEQ ID NO: 36525 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKSGVSNKDIEKETAKDAGAEPPSMTQLLRR

SEQ ID NO: 36526 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKSGVSNKDIEKETAKDASGEPPSMTQLLRR

SEQ ID NO: 36527 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKSGVSNKDIEKETAKDASSEPPSMTQLLRR

SEQ ID NO: 36528 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKSGVSNKDIEKETAKDASAEPPSMTQLLRR

SEQ ID NO: 36529 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKSGVSNKDIEKETAKDAAGEPPSMTQLLRR

SEQ ID NO: 36530 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKSGVSNKDIEKETAKDAASEPPSMTQLLRR

SEQ ID NO: 36531 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKSGVSNKDIEKETAKDAAAEPPSMTQLLRR

SEQ ID NO: 36532 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKAGVSNKDIEKETAKDGGGEPPSMTQLLRR

SEQ ID NO: 36533 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKAGVSNKDIEKETAKDGGSEPPSMTQLLRR

SEQ ID NO: 36534 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKAGVSNKDIEKETAKDGGAEPPSMTQLLRR

SEQ ID NO: 36535 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKAGVSNKDIEKETAKDGSGEPPSMTQLLRR

SEQ ID NO: 36536 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKAGVSNKDIEKETAKDGSSEPPSMTQLLRR

SEQ ID NO: 36537 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKAGVSNKDIEKETAKDGSAEPPSMTQLLRR

SEQ ID NO: 36538 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKAGVSNKDIEKETAKDGAGEPPSMTQLLRR

SEQ ID NO: 36539 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKAGVSNKDIEKETAKDGASEPPSMTQLLRR

SEQ ID NO: 36540 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKAGVSNKDIEKETAKDGAAEPPSMTQLLRR

SEQ ID NO: 36541 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKAGVSNKDIEKETAKDSGGEPPSMTQLLRR

SEQ ID NO: 36542 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKAGVSNKDIEKETAKDSGSEPPSMTQLLRR

SEQ ID NO: 36543 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKAGVSNKDIEKETAKDSGAEPPSMTQLLRR

SEQ ID NO: 36544 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKAGVSNKDIEKETAKDSSGEPPSMTQLLRR

SEQ ID NO: 36545 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKAGVSNKDIEKETAKDSSSEPPSMTQLLRR

SEQ ID NO: 36546 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKAGVSNKDIEKETAKDSSAEPPSMTQLLRR

SEQ ID NO: 36547 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKAGVSNKDIEKETAKDSAGEPPSMTQLLRR

SEQ ID NO: 36548 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKAGVSNKDIEKETAKDSASEPPSMTQLLRR

SEQ ID NO: 36549 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKAGVSNKDIEKETAKDSAAEPPSMTQLLRR

SEQ ID NO: 36550 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKAGVSNKDIEKETAKDAGGEPPSMTQLLRR

SEQ ID NO: 36551 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKAGVSNKDIEKETAKDAGSEPPSMTQLLRR

SEQ ID NO: 36552 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKAGVSNKDIEKETAKDAGAEPPSMTQLLRR

SEQ ID NO: 36553 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKAGVSNKDIEKETAKDASGEPPSMTQLLRR

SEQ ID NO: 36554 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKAGVSNKDIEKETAKDASSEPPSMTQLLRR

SEQ ID NO: 36555 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKAGVSNKDIEKETAKDASAEPPSMTQLLRR

SEQ ID NO: 36556 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKAGVSNKDIEKETAKDAAGEPPSMTQLLRR

SEQ ID NO: 36557 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKAGVSNKDIEKETAKDAASEPPSMTQLLRR

SEQ ID NO: 36558 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKAGVSNKDIEKETAKDAAAEPPSMTQLLRR

SEQ ID NO: 36559 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKGGVSNKDIEKETAKDGGGEPPSMTQLLRR

SEQ ID NO: 36560 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKGGVSNKDIEKETAKDGGSEPPSMTQLLRR

SEQ ID NO: 36561 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKGGVSNKDIEKETAKDGGAEPPSMTQLLRR

SEQ ID NO: 36562 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKGGVSNKDIEKETAKDGSGEPPSMTQLLRR

SEQ ID NO: 36563 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKGGVSNKDIEKETAKDGSSEPPSMTQLLRR

SEQ ID NO: 36564 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKGGVSNKDIEKETAKDGSAEPPSMTQLLRR

SEQ ID NO: 36565 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKGGVSNKDIEKETAKDGAGEPPSMTQLLRR

SEQ ID NO: 36566 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKGGVSNKDIEKETAKDGASEPPSMTQLLRR

SEQ ID NO: 36567 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKGGVSNKDIEKETAKDGAAEPPSMTQLLRR

SEQ ID NO: 36568 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKGGVSNKDIEKETAKDSGGEPPSMTQLLRR

SEQ ID NO: 36569 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKGGVSNKDIEKETAKDSGSEPPSMTQLLRR

SEQ ID NO: 36570 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKGGVSNKDIEKETAKDSGAEPPSMTQLLRR

SEQ ID NO: 36571 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKGGVSNKDIEKETAKDSSGEPPSMTQLLRR

SEQ ID NO: 36572 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKGGVSNKDIEKETAKDSSSEPPSMTQLLRR

SEQ ID NO: 36573 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKGGVSNKDIEKETAKDSSAEPPSMTQLLRR

SEQ ID NO: 36574 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKGGVSNKDIEKETAKDSAGEPPSMTQLLRR

SEQ ID NO: 36575 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKGGVSNKDIEKETAKDSASEPPSMTQLLRR

SEQ ID NO: 36576 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKGGVSNKDIEKETAKDSAAEPPSMTQLLRR

SEQ ID NO: 36577 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKGGVSNKDIEKETAKDAGGEPPSMTQLLRR

SEQ ID NO: 36578 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKGGVSNKDIEKETAKDAGSEPPSMTQLLRR

SEQ ID NO: 36579 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKGGVSNKDIEKETAKDAGAEPPSMTQLLRR

SEQ ID NO: 36580 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKGGVSNKDIEKETAKDASGEPPSMTQLLRR

SEQ ID NO: 36581 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKGGVSNKDIEKETAKDASSEPPSMTQLLRR

SEQ ID NO: 36582 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKGGVSNKDIEKETAKDASAEPPSMTQLLRR

SEQ ID NO: 36583 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKGGVSNKDIEKETAKDAAGEPPSMTQLLRR

SEQ ID NO: 36584 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKGGVSNKDIEKETAKDAASEPPSMTQLLRR

SEQ ID NO: 36585 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKGGVSNKDIEKETAKDAAAEPPSMTQLLRR

SEQ ID NO: 36586 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKDGVSNKDIEKETAKDGGGEPPSMTQLLRR

SEQ ID NO: 36587 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKDGVSNKDIEKETAKDGGSEPPSMTQLLRR

SEQ ID NO: 36588 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKDGVSNKDIEKETAKDGGAEPPSMTQLLRR

SEQ ID NO: 36589 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKDGVSNKDIEKETAKDGSGEPPSMTQLLRR

SEQ ID NO: 36590 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKDGVSNKDIEKETAKDGSSEPPSMTQLLRR

SEQ ID NO: 36591 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKDGVSNKDIEKETAKDGSAEPPSMTQLLRR

SEQ ID NO: 36592 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKDGVSNKDIEKETAKDGAGEPPSMTQLLRR

SEQ ID NO: 36593 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKDGVSNKDIEKETAKDGASEPPSMTQLLRR

SEQ ID NO: 36594 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKDGVSNKDIEKETAKDGAAEPPSMTQLLRR

SEQ ID NO: 36595 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKDGVSNKDIEKETAKDSGGEPPSMTQLLRR

SEQ ID NO: 36596 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKDGVSNKDIEKETAKDSGSEPPSMTQLLRR

SEQ ID NO: 36597 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKDGVSNKDIEKETAKDSGAEPPSMTQLLRR

SEQ ID NO: 36598 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKDGVSNKDIEKETAKDSSGEPPSMTQLLRR

SEQ ID NO: 36599 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKDGVSNKDIEKETAKDSSSEPPSMTQLLRR

SEQ ID NO: 36600 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKDGVSNKDIEKETAKDSSAEPPSMTQLLRR

SEQ ID NO: 36601 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKDGVSNKDIEKETAKDSAGEPPSMTQLLRR

SEQ ID NO: 36602 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKDGVSNKDIEKETAKDSASEPPSMTQLLRR

SEQ ID NO: 36603 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKDGVSNKDIEKETAKDSAAEPPSMTQLLRR

SEQ ID NO: 36604 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKDGVSNKDIEKETAKDAGGEPPSMTQLLRR

SEQ ID NO: 36605 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKDGVSNKDIEKETAKDAGSEPPSMTQLLRR

SEQ ID NO: 36606 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKDGVSNKDIEKETAKDAGAEPPSMTQLLRR

SEQ ID NO: 36607 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKDGVSNKDIEKETAKDASGEPPSMTQLLRR

SEQ ID NO: 36608 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKDGVSNKDIEKETAKDASSEPPSMTQLLRR

SEQ ID NO: 36609 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKDGVSNKDIEKETAKDASAEPPSMTQLLRR

SEQ ID NO: 36610 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKDGVSNKDIEKETAKDAAGEPPSMTQLLRR

SEQ ID NO: 36611 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKDGVSNKDIEKETAKDAASEPPSMTQLLRR

SEQ ID NO: 36612 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKDGVSNKDIEKETAKDAAAEPPSMTQLLRR

SEQ ID NO: 36613 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKHGVSNKDIEKETAKDGGGEPPSMTQLLRR

SEQ ID NO: 36614 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKHGVSNKDIEKETAKDGGSEPPSMTQLLRR

SEQ ID NO: 36615 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKHGVSNKDIEKETAKDGGAEPPSMTQLLRR

SEQ ID NO: 36616 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKHGVSNKDIEKETAKDGSGEPPSMTQLLRR

SEQ ID NO: 36617 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKHGVSNKDIEKETAKDGSSEPPSMTQLLRR

SEQ ID NO: 36618 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKHGVSNKDIEKETAKDGSAEPPSMTQLLRR

SEQ ID NO: 36619 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKHGVSNKDIEKETAKDGAGEPPSMTQLLRR

SEQ ID NO: 36620 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKHGVSNKDIEKETAKDGASEPPSMTQLLRR

SEQ ID NO: 36621 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKHGVSNKDIEKETAKDGAAEPPSMTQLLRR

SEQ ID NO: 36622 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKHGVSNKDIEKETAKDSGGEPPSMTQLLRR

SEQ ID NO: 36623 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKHGVSNKDIEKETAKDSGSEPPSMTQLLRR

SEQ ID NO: 36624 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKHGVSNKDIEKETAKDSGAEPPSMTQLLRR

SEQ ID NO: 36625 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKHGVSNKDIEKETAKDSSGEPPSMTQLLRR

SEQ ID NO: 36626 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKHGVSNKDIEKETAKDSSSEPPSMTQLLRR

SEQ ID NO: 36627 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKHGVSNKDIEKETAKDSSAEPPSMTQLLRR

SEQ ID NO: 36628 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKHGVSNKDIEKETAKDSAGEPPSMTQLLRR

SEQ ID NO: 36629 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKHGVSNKDIEKETAKDSASEPPSMTQLLRR

SEQ ID NO: 36630 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKHGVSNKDIEKETAKDSAAEPPSMTQLLRR

SEQ ID NO: 36631 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKHGVSNKDIEKETAKDAGGEPPSMTQLLRR

SEQ ID NO: 36632 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKHGVSNKDIEKETAKDAGSEPPSMTQLLRR

SEQ ID NO: 36633 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKHGVSNKDIEKETAKDAGAEPPSMTQLLRR

SEQ ID NO: 36634 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKHGVSNKDIEKETAKDASGEPPSMTQLLRR

SEQ ID NO: 36635 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKHGVSNKDIEKETAKDASSEPPSMTQLLRR

SEQ ID NO: 36636 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKHGVSNKDIEKETAKDASAEPPSMTQLLRR

SEQ ID NO: 36637 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKHGVSNKDIEKETAKDAAGEPPSMTQLLRR

SEQ ID NO: 36638 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKHGVSNKDIEKETAKDAASEPPSMTQLLRR

SEQ ID NO: 36639 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKHGVSNKDIEKETAKDAAAEPPSMTQLLRR

SEQ ID NO: 36640 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKYGVSNKDIEKETAKDGGGEPPSMTQLLRR

SEQ ID NO: 36641 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKYGVSNKDIEKETAKDGGSEPPSMTQLLRR

SEQ ID NO: 36642 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKYGVSNKDIEKETAKDGGAEPPSMTQLLRR

SEQ ID NO: 36643 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKYGVSNKDIEKETAKDGSGEPPSMTQLLRR

SEQ ID NO: 36644 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKYGVSNKDIEKETAKDGSSEPPSMTQLLRR

SEQ ID NO: 36645 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKYGVSNKDIEKETAKDGSAEPPSMTQLLRR

SEQ ID NO: 36646 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKYGVSNKDIEKETAKDGAGEPPSMTQLLRR

SEQ ID NO: 36647 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKYGVSNKDIEKETAKDGASEPPSMTQLLRR

SEQ ID NO: 36648 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKYGVSNKDIEKETAKDGAAEPPSMTQLLRR

SEQ ID NO: 36649 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKYGVSNKDIEKETAKDSGGEPPSMTQLLRR

SEQ ID NO: 36650 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKYGVSNKDIEKETAKDSGSEPPSMTQLLRR

SEQ ID NO: 36651 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKYGVSNKDIEKETAKDSGAEPPSMTQLLRR

SEQ ID NO: 36652 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKYGVSNKDIEKETAKDSSGEPPSMTQLLRR

SEQ ID NO: 36653 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKYGVSNKDIEKETAKDSSSEPPSMTQLLRR

SEQ ID NO: 36654 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKYGVSNKDIEKETAKDSSAEPPSMTQLLRR

SEQ ID NO: 36655 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKYGVSNKDIEKETAKDSAGEPPSMTQLLRR

SEQ ID NO: 36656 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKYGVSNKDIEKETAKDSASEPPSMTQLLRR

SEQ ID NO: 36657 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKYGVSNKDIEKETAKDSAAEPPSMTQLLRR

SEQ ID NO: 36658 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKYGVSNKDIEKETAKDAGGEPPSMTQLLRR

SEQ ID NO: 36659 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKYGVSNKDIEKETAKDAGSEPPSMTQLLRR

SEQ ID NO: 36660 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKYGVSNKDIEKETAKDAGAEPPSMTQLLRR

SEQ ID NO: 36661 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKYGVSNKDIEKETAKDASGEPPSMTQLLRR

SEQ ID NO: 36662 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKYGVSNKDIEKETAKDASSEPPSMTQLLRR

SEQ ID NO: 36663 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKYGVSNKDIEKETAKDASAEPPSMTQLLRR

SEQ ID NO: 36664 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKYGVSNKDIEKETAKDAAGEPPSMTQLLRR

SEQ ID NO: 36665 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKYGVSNKDIEKETAKDAASEPPSMTQLLRR

SEQ ID NO: 36666 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKYGVSNKDIEKETAKDAAAEPPSMTQLLRR

SEQ ID NO: 36667 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKKGVSNKDIEKETAKDGGGEPPSMTQLLRR

SEQ ID NO: 36668 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKKGVSNKDIEKETAKDGGSEPPSMTQLLRR

SEQ ID NO: 36669 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKKGVSNKDIEKETAKDGGAEPPSMTQLLRR

SEQ ID NO: 36670 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKKGVSNKDIEKETAKDGSGEPPSMTQLLRR

SEQ ID NO: 36671 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKKGVSNKDIEKETAKDGSSEPPSMTQLLRR

SEQ ID NO: 36672 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKKGVSNKDIEKETAKDGSAEPPSMTQLLRR

SEQ ID NO: 36673 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKKGVSNKDIEKETAKDGAGEPPSMTQLLRR

SEQ ID NO: 36674 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKKGVSNKDIEKETAKDGASEPPSMTQLLRR

SEQ ID NO: 36675 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKKGVSNKDIEKETAKDGAAEPPSMTQLLRR

SEQ ID NO: 36676 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKKGVSNKDIEKETAKDSGGEPPSMTQLLRR

SEQ ID NO: 36677 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKKGVSNKDIEKETAKDSGSEPPSMTQLLRR

SEQ ID NO: 36678 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKKGVSNKDIEKETAKDSGAEPPSMTQLLRR

SEQ ID NO: 36679 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKKGVSNKDIEKETAKDSSGEPPSMTQLLRR

SEQ ID NO: 36680 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKKGVSNKDIEKETAKDSSSEPPSMTQLLRR

SEQ ID NO: 36681 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKKGVSNKDIEKETAKDSSAEPPSMTQLLRR

SEQ ID NO: 36682 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKKGVSNKDIEKETAKDSAGEPPSMTQLLRR

SEQ ID NO: 36683 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKKGVSNKDIEKETAKDSASEPPSMTQLLRR

SEQ ID NO: 36684 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKKGVSNKDIEKETAKDSAAEPPSMTQLLRR

SEQ ID NO: 36685 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKKGVSNKDIEKETAKDAGGEPPSMTQLLRR

SEQ ID NO: 36686 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKKGVSNKDIEKETAKDAGSEPPSMTQLLRR

SEQ ID NO: 36687 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKKGVSNKDIEKETAKDAGAEPPSMTQLLRR

SEQ ID NO: 36688 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKKGVSNKDIEKETAKDASGEPPSMTQLLRR

SEQ ID NO: 36689 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKKGVSNKDIEKETAKDASSEPPSMTQLLRR

SEQ ID NO: 36690 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKKGVSNKDIEKETAKDASAEPPSMTQLLRR

SEQ ID NO: 36691 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKKGVSNKDIEKETAKDAAGEPPSMTQLLRR

SEQ ID NO: 36692 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKKGVSNKDIEKETAKDAASEPPSMTQLLRR

SEQ ID NO: 36693 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKKGVSNKDIEKETAKDAAAEPPSMTQLLRR

SEQ ID NO: 36694 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKNGVSNKDIEKETAKDGGGEPPSMTQLLRR

SEQ ID NO: 36695 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKNGVSNKDIEKETAKDGGSEPPSMTQLLRR

SEQ ID NO: 36696 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKNGVSNKDIEKETAKDGGAEPPSMTQLLRR

SEQ ID NO: 36697 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKNGVSNKDIEKETAKDGSGEPPSMTQLLRR

SEQ ID NO: 36698 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKNGVSNKDIEKETAKDGSSEPPSMTQLLRR

SEQ ID NO: 36699 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKNGVSNKDIEKETAKDGSAEPPSMTQLLRR

SEQ ID NO: 36700 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKNGVSNKDIEKETAKDGAGEPPSMTQLLRR

SEQ ID NO: 36701 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKNGVSNKDIEKETAKDGASEPPSMTQLLRR

SEQ ID NO: 36702 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKNGVSNKDIEKETAKDGAAEPPSMTQLLRR

SEQ ID NO: 36703 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKNGVSNKDIEKETAKDSGGEPPSMTQLLRR

SEQ ID NO: 36704 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKNGVSNKDIEKETAKDSGSEPPSMTQLLRR

SEQ ID NO: 36705 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKNGVSNKDIEKETAKDSGAEPPSMTQLLRR

SEQ ID NO: 36706 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKNGVSNKDIEKETAKDSSGEPPSMTQLLRR

SEQ ID NO: 36707 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKNGVSNKDIEKETAKDSSSEPPSMTQLLRR

SEQ ID NO: 36708 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKNGVSNKDIEKETAKDSSAEPPSMTQLLRR

SEQ ID NO: 36709 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKNGVSNKDIEKETAKDSAGEPPSMTQLLRR

SEQ ID NO: 36710 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKNGVSNKDIEKETAKDSASEPPSMTQLLRR

SEQ ID NO: 36711 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKNGVSNKDIEKETAKDSAAEPPSMTQLLRR

SEQ ID NO: 36712 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKNGVSNKDIEKETAKDAGGEPPSMTQLLRR

SEQ ID NO: 36713 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKNGVSNKDIEKETAKDAGSEPPSMTQLLRR

SEQ ID NO: 36714 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKNGVSNKDIEKETAKDAGAEPPSMTQLLRR

SEQ ID NO: 36715 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKNGVSNKDIEKETAKDASGEPPSMTQLLRR

SEQ ID NO: 36716 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKNGVSNKDIEKETAKDASSEPPSMTQLLRR

SEQ ID NO: 36717 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKNGVSNKDIEKETAKDASAEPPSMTQLLRR

SEQ ID NO: 36718 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKNGVSNKDIEKETAKDAAGEPPSMTQLLRR

SEQ ID NO: 36719 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKNGVSNKDIEKETAKDAASEPPSMTQLLRR

SEQ ID NO: 36720 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKNGVSNKDIEKETAKDAAAEPPSMTQLLRR

SEQ ID NO: 36721 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKMGVSNKDIEKETAKDGGGEPPSMTQLLRR

SEQ ID NO: 36722 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKMGVSNKDIEKETAKDGGSEPPSMTQLLRR

SEQ ID NO: 36723 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKMGVSNKDIEKETAKDGGAEPPSMTQLLRR

SEQ ID NO: 36724 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKMGVSNKDIEKETAKDGSGEPPSMTQLLRR

SEQ ID NO: 36725 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKMGVSNKDIEKETAKDGSSEPPSMTQLLRR

SEQ ID NO: 36726 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKMGVSNKDIEKETAKDGSAEPPSMTQLLRR

SEQ ID NO: 36727 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKMGVSNKDIEKETAKDGAGEPPSMTQLLRR

SEQ ID NO: 36728 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKMGVSNKDIEKETAKDGASEPPSMTQLLRR

SEQ ID NO: 36729 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKMGVSNKDIEKETAKDGAAEPPSMTQLLRR

SEQ ID NO: 36730 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKMGVSNKDIEKETAKDSGGEPPSMTQLLRR

SEQ ID NO: 36731 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKMGVSNKDIEKETAKDSGSEPPSMTQLLRR

SEQ ID NO: 36732 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKMGVSNKDIEKETAKDSGAEPPSMTQLLRR

SEQ ID NO: 36733 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKMGVSNKDIEKETAKDSSGEPPSMTQLLRR

SEQ ID NO: 36734 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKMGVSNKDIEKETAKDSSSEPPSMTQLLRR

SEQ ID NO: 36735 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKMGVSNKDIEKETAKDSSAEPPSMTQLLRR

SEQ ID NO: 36736 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKMGVSNKDIEKETAKDSAGEPPSMTQLLRR

SEQ ID NO: 36737 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKMGVSNKDIEKETAKDSASEPPSMTQLLRR

SEQ ID NO: 36738 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKMGVSNKDIEKETAKDSAAEPPSMTQLLRR

SEQ ID NO: 36739 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKMGVSNKDIEKETAKDAGGEPPSMTQLLRR

SEQ ID NO: 36740 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKMGVSNKDIEKETAKDAGSEPPSMTQLLRR

SEQ ID NO: 36741 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKMGVSNKDIEKETAKDAGAEPPSMTQLLRR

SEQ ID NO: 36742 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKMGVSNKDIEKETAKDASGEPPSMTQLLRR

SEQ ID NO: 36743 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKMGVSNKDIEKETAKDASSEPPSMTQLLRR

SEQ ID NO: 36744 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKMGVSNKDIEKETAKDASAEPPSMTQLLRR

SEQ ID NO: 36745 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKMGVSNKDIEKETAKDAAGEPPSMTQLLRR

SEQ ID NO: 36746 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKMGVSNKDIEKETAKDAASEPPSMTQLLRR

SEQ ID NO: 36747 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKMGVSNKDIEKETAKDAAAEPPSMTQLLRR

SEQ ID NO: 36748 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKCGVSNKDIEKETAKDGGGEPPSMTQLLRR

SEQ ID NO: 36749 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKCGVSNKDIEKETAKDGGSEPPSMTQLLRR

SEQ ID NO: 36750 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKCGVSNKDIEKETAKDGGAEPPSMTQLLRR

SEQ ID NO: 36751 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKCGVSNKDIEKETAKDGSGEPPSMTQLLRR

SEQ ID NO: 36752 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKCGVSNKDIEKETAKDGSSEPPSMTQLLRR

SEQ ID NO: 36753 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKCGVSNKDIEKETAKDGSAEPPSMTQLLRR

SEQ ID NO: 36754 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKCGVSNKDIEKETAKDGAGEPPSMTQLLRR

SEQ ID NO: 36755 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKCGVSNKDIEKETAKDGASEPPSMTQLLRR

SEQ ID NO: 36756 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKCGVSNKDIEKETAKDGAAEPPSMTQLLRR

SEQ ID NO: 36757 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKCGVSNKDIEKETAKDSGGEPPSMTQLLRR

SEQ ID NO: 36758 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKCGVSNKDIEKETAKDSGSEPPSMTQLLRR

SEQ ID NO: 36759 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKCGVSNKDIEKETAKDSGAEPPSMTQLLRR

SEQ ID NO: 36760 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKCGVSNKDIEKETAKDSSGEPPSMTQLLRR

SEQ ID NO: 36761 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKCGVSNKDIEKETAKDSSSEPPSMTQLLRR

SEQ ID NO: 36762 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKCGVSNKDIEKETAKDSSAEPPSMTQLLRR

SEQ ID NO: 36763 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKCGVSNKDIEKETAKDSAGEPPSMTQLLRR

SEQ ID NO: 36764 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKCGVSNKDIEKETAKDSASEPPSMTQLLRR

SEQ ID NO: 36765 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKCGVSNKDIEKETAKDSAAEPPSMTQLLRR

SEQ ID NO: 36766 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKCGVSNKDIEKETAKDAGGEPPSMTQLLRR

SEQ ID NO: 36767 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKCGVSNKDIEKETAKDAGSEPPSMTQLLRR

SEQ ID NO: 36768 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKCGVSNKDIEKETAKDAGAEPPSMTQLLRR

SEQ ID NO: 36769 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKCGVSNKDIEKETAKDASGEPPSMTQLLRR

SEQ ID NO: 36770 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKCGVSNKDIEKETAKDASSEPPSMTQLLRR

SEQ ID NO: 36771 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKCGVSNKDIEKETAKDASAEPPSMTQLLRR

SEQ ID NO: 36772 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKCGVSNKDIEKETAKDAAGEPPSMTQLLRR

SEQ ID NO: 36773 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKCGVSNKDIEKETAKDAASEPPSMTQLLRR

SEQ ID NO: 36774 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKCGVSNKDIEKETAKDAAAEPPSMTQLLRR

SEQ ID NO: 36775 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKSGVSNKDIEKETAKDGGGEPPSMTQLLRR

SEQ ID NO: 36776 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKSGVSNKDIEKETAKDGGSEPPSMTQLLRR

SEQ ID NO: 36777 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKSGVSNKDIEKETAKDGGAEPPSMTQLLRR

SEQ ID NO: 36778 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKSGVSNKDIEKETAKDGSGEPPSMTQLLRR

SEQ ID NO: 36779 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKSGVSNKDIEKETAKDGSSEPPSMTQLLRR

SEQ ID NO: 36780 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKSGVSNKDIEKETAKDGSAEPPSMTQLLRR

SEQ ID NO: 36781 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKSGVSNKDIEKETAKDGAGEPPSMTQLLRR

SEQ ID NO: 36782 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKSGVSNKDIEKETAKDGASEPPSMTQLLRR

SEQ ID NO: 36783 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKSGVSNKDIEKETAKDGAAEPPSMTQLLRR

SEQ ID NO: 36784 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKSGVSNKDIEKETAKDSGGEPPSMTQLLRR

SEQ ID NO: 36785 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKSGVSNKDIEKETAKDSGSEPPSMTQLLRR

SEQ ID NO: 36786 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKSGVSNKDIEKETAKDSGAEPPSMTQLLRR

SEQ ID NO: 36787 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKSGVSNKDIEKETAKDSSGEPPSMTQLLRR

SEQ ID NO: 36788 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKSGVSNKDIEKETAKDSSSEPPSMTQLLRR

SEQ ID NO: 36789 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKSGVSNKDIEKETAKDSSAEPPSMTQLLRR

SEQ ID NO: 36790 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKSGVSNKDIEKETAKDSAGEPPSMTQLLRR

SEQ ID NO: 36791 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKSGVSNKDIEKETAKDSASEPPSMTQLLRR

SEQ ID NO: 36792 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKSGVSNKDIEKETAKDSAAEPPSMTQLLRR

SEQ ID NO: 36793 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKSGVSNKDIEKETAKDAGGEPPSMTQLLRR

SEQ ID NO: 36794 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKSGVSNKDIEKETAKDAGSEPPSMTQLLRR

SEQ ID NO: 36795 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKSGVSNKDIEKETAKDAGAEPPSMTQLLRR

SEQ ID NO: 36796 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKSGVSNKDIEKETAKDASGEPPSMTQLLRR

SEQ ID NO: 36797 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKSGVSNKDIEKETAKDASSEPPSMTQLLRR

SEQ ID NO: 36798 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKSGVSNKDIEKETAKDASAEPPSMTQLLRR

SEQ ID NO: 36799 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKSGVSNKDIEKETAKDAAGEPPSMTQLLRR

SEQ ID NO: 36800 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKSGVSNKDIEKETAKDAASEPPSMTQLLRR

SEQ ID NO: 36801 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKSGVSNKDIEKETAKDAAAEPPSMTQLLRR

SEQ ID NO: 36802 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKAGVSNKDIEKETAKDGGGEPPSMTQLLRR

SEQ ID NO: 36803 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKAGVSNKDIEKETAKDGGSEPPSMTQLLRR

SEQ ID NO: 36804 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKAGVSNKDIEKETAKDGGAEPPSMTQLLRR

SEQ ID NO: 36805 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKAGVSNKDIEKETAKDGSGEPPSMTQLLRR

SEQ ID NO: 36806 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKAGVSNKDIEKETAKDGSSEPPSMTQLLRR

SEQ ID NO: 36807 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKAGVSNKDIEKETAKDGSAEPPSMTQLLRR

SEQ ID NO: 36808 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKAGVSNKDIEKETAKDGAGEPPSMTQLLRR

SEQ ID NO: 36809 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKAGVSNKDIEKETAKDGASEPPSMTQLLRR

SEQ ID NO: 36810 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKAGVSNKDIEKETAKDGAAEPPSMTQLLRR

SEQ ID NO: 36811 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKAGVSNKDIEKETAKDSGGEPPSMTQLLRR

SEQ ID NO: 36812 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKAGVSNKDIEKETAKDSGSEPPSMTQLLRR

SEQ ID NO: 36813 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKAGVSNKDIEKETAKDSGAEPPSMTQLLRR

SEQ ID NO: 36814 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKAGVSNKDIEKETAKDSSGEPPSMTQLLRR

SEQ ID NO: 36815 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKAGVSNKDIEKETAKDSSSEPPSMTQLLRR

SEQ ID NO: 36816 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKAGVSNKDIEKETAKDSSAEPPSMTQLLRR

SEQ ID NO: 36817 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKAGVSNKDIEKETAKDSAGEPPSMTQLLRR

SEQ ID NO: 36818 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKAGVSNKDIEKETAKDSASEPPSMTQLLRR

SEQ ID NO: 36819 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKAGVSNKDIEKETAKDSAAEPPSMTQLLRR

SEQ ID NO: 36820 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKAGVSNKDIEKETAKDAGGEPPSMTQLLRR

SEQ ID NO: 36821 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKAGVSNKDIEKETAKDAGSEPPSMTQLLRR

SEQ ID NO: 36822 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKAGVSNKDIEKETAKDAGAEPPSMTQLLRR

SEQ ID NO: 36823 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKAGVSNKDIEKETAKDASGEPPSMTQLLRR

SEQ ID NO: 36824 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKAGVSNKDIEKETAKDASSEPPSMTQLLRR

SEQ ID NO: 36825 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKAGVSNKDIEKETAKDASAEPPSMTQLLRR

SEQ ID NO: 36826 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKAGVSNKDIEKETAKDAAGEPPSMTQLLRR

SEQ ID NO: 36827 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKAGVSNKDIEKETAKDAASEPPSMTQLLRR

SEQ ID NO: 36828 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKAGVSNKDIEKETAKDAAAEPPSMTQLLRR

SEQ ID NO: 36829 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKGGVSNKDIEKETAKDGGGEPPSMTQLLRR

SEQ ID NO: 36830 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKGGVSNKDIEKETAKDGGSEPPSMTQLLRR

SEQ ID NO: 36831 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKGGVSNKDIEKETAKDGGAEPPSMTQLLRR

SEQ ID NO: 36832 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKGGVSNKDIEKETAKDGSGEPPSMTQLLRR

SEQ ID NO: 36833 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKGGVSNKDIEKETAKDGSSEPPSMTQLLRR

SEQ ID NO: 36834 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKGGVSNKDIEKETAKDGSAEPPSMTQLLRR

SEQ ID NO: 36835 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKGGVSNKDIEKETAKDGAGEPPSMTQLLRR

SEQ ID NO: 36836 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKGGVSNKDIEKETAKDGASEPPSMTQLLRR

SEQ ID NO: 36837 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKGGVSNKDIEKETAKDGAAEPPSMTQLLRR

SEQ ID NO: 36838 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKGGVSNKDIEKETAKDSGGEPPSMTQLLRR

SEQ ID NO: 36839 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKGGVSNKDIEKETAKDSGSEPPSMTQLLRR

SEQ ID NO: 36840 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKGGVSNKDIEKETAKDSGAEPPSMTQLLRR

SEQ ID NO: 36841 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKGGVSNKDIEKETAKDSSGEPPSMTQLLRR

SEQ ID NO: 36842 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKGGVSNKDIEKETAKDSSSEPPSMTQLLRR

SEQ ID NO: 36843 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKGGVSNKDIEKETAKDSSAEPPSMTQLLRR

SEQ ID NO: 36844 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKGGVSNKDIEKETAKDSAGEPPSMTQLLRR

SEQ ID NO: 36845 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKGGVSNKDIEKETAKDSASEPPSMTQLLRR

SEQ ID NO: 36846 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKGGVSNKDIEKETAKDSAAEPPSMTQLLRR

SEQ ID NO: 36847 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKGGVSNKDIEKETAKDAGGEPPSMTQLLRR

SEQ ID NO: 36848 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKGGVSNKDIEKETAKDAGSEPPSMTQLLRR

SEQ ID NO: 36849 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKGGVSNKDIEKETAKDAGAEPPSMTQLLRR

SEQ ID NO: 36850 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKGGVSNKDIEKETAKDASGEPPSMTQLLRR

SEQ ID NO: 36851 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKGGVSNKDIEKETAKDASSEPPSMTQLLRR

SEQ ID NO: 36852 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKGGVSNKDIEKETAKDASAEPPSMTQLLRR

SEQ ID NO: 36853 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKGGVSNKDIEKETAKDAAGEPPSMTQLLRR

SEQ ID NO: 36854 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKGGVSNKDIEKETAKDAASEPPSMTQLLRR

SEQ ID NO: 36855 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKGGVSNKDIEKETAKDAAAEPPSMTQLLRR

SEQ ID NO: 36856 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKDGVSNKDIEKETAKDGGGEPPSMTQLLRR

SEQ ID NO: 36857 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKDGVSNKDIEKETAKDGGSEPPSMTQLLRR

SEQ ID NO: 36858 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKDGVSNKDIEKETAKDGGAEPPSMTQLLRR

SEQ ID NO: 36859 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKDGVSNKDIEKETAKDGSGEPPSMTQLLRR

SEQ ID NO: 36860 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKDGVSNKDIEKETAKDGSSEPPSMTQLLRR

SEQ ID NO: 36861 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKDGVSNKDIEKETAKDGSAEPPSMTQLLRR

SEQ ID NO: 36862 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKDGVSNKDIEKETAKDGAGEPPSMTQLLRR

SEQ ID NO: 36863 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKDGVSNKDIEKETAKDGASEPPSMTQLLRR

SEQ ID NO: 36864 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKDGVSNKDIEKETAKDGAAEPPSMTQLLRR

SEQ ID NO: 36865 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKDGVSNKDIEKETAKDSGGEPPSMTQLLRR

SEQ ID NO: 36866 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKDGVSNKDIEKETAKDSGSEPPSMTQLLRR

SEQ ID NO: 36867 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKDGVSNKDIEKETAKDSGAEPPSMTQLLRR

SEQ ID NO: 36868 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKDGVSNKDIEKETAKDSSGEPPSMTQLLRR

SEQ ID NO: 36869 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKDGVSNKDIEKETAKDSSSEPPSMTQLLRR

SEQ ID NO: 36870 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKDGVSNKDIEKETAKDSSAEPPSMTQLLRR

SEQ ID NO: 36871 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKDGVSNKDIEKETAKDSAGEPPSMTQLLRR

SEQ ID NO: 36872 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKDGVSNKDIEKETAKDSASEPPSMTQLLRR

SEQ ID NO: 36873 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKDGVSNKDIEKETAKDSAAEPPSMTQLLRR

SEQ ID NO: 36874 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKDGVSNKDIEKETAKDAGGEPPSMTQLLRR

SEQ ID NO: 36875 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKDGVSNKDIEKETAKDAGSEPPSMTQLLRR

SEQ ID NO: 36876 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKDGVSNKDIEKETAKDAGAEPPSMTQLLRR

SEQ ID NO: 36877 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKDGVSNKDIEKETAKDASGEPPSMTQLLRR

SEQ ID NO: 36878 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKDGVSNKDIEKETAKDASSEPPSMTQLLRR

SEQ ID NO: 36879 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKDGVSNKDIEKETAKDASAEPPSMTQLLRR

SEQ ID NO: 36880 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKDGVSNKDIEKETAKDAAGEPPSMTQLLRR

SEQ ID NO: 36881 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKDGVSNKDIEKETAKDAASEPPSMTQLLRR

SEQ ID NO: 36882 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKDGVSNKDIEKETAKDAAAEPPSMTQLLRR

SEQ ID NO: 36883 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKHGVSNKDIEKETAKDGGGEPPSMTQLLRR

SEQ ID NO: 36884 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKHGVSNKDIEKETAKDGGSEPPSMTQLLRR

SEQ ID NO: 36885 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKHGVSNKDIEKETAKDGGAEPPSMTQLLRR

SEQ ID NO: 36886 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKHGVSNKDIEKETAKDGSGEPPSMTQLLRR

SEQ ID NO: 36887 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKHGVSNKDIEKETAKDGSSEPPSMTQLLRR

SEQ ID NO: 36888 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKHGVSNKDIEKETAKDGSAEPPSMTQLLRR

SEQ ID NO: 36889 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKHGVSNKDIEKETAKDGAGEPPSMTQLLRR

SEQ ID NO: 36890 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKHGVSNKDIEKETAKDGASEPPSMTQLLRR

SEQ ID NO: 36891 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKHGVSNKDIEKETAKDGAAEPPSMTQLLRR

SEQ ID NO: 36892 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKHGVSNKDIEKETAKDSGGEPPSMTQLLRR

SEQ ID NO: 36893 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKHGVSNKDIEKETAKDSGSEPPSMTQLLRR

SEQ ID NO: 36894 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKHGVSNKDIEKETAKDSGAEPPSMTQLLRR

SEQ ID NO: 36895 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKHGVSNKDIEKETAKDSSGEPPSMTQLLRR

SEQ ID NO: 36896 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKHGVSNKDIEKETAKDSSSEPPSMTQLLRR

SEQ ID NO: 36897 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKHGVSNKDIEKETAKDSSAEPPSMTQLLRR

SEQ ID NO: 36898 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKHGVSNKDIEKETAKDSAGEPPSMTQLLRR

SEQ ID NO: 36899 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKHGVSNKDIEKETAKDSASEPPSMTQLLRR

SEQ ID NO: 36900 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKHGVSNKDIEKETAKDSAAEPPSMTQLLRR

SEQ ID NO: 36901 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKHGVSNKDIEKETAKDAGGEPPSMTQLLRR

SEQ ID NO: 36902 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKHGVSNKDIEKETAKDAGSEPPSMTQLLRR

SEQ ID NO: 36903 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKHGVSNKDIEKETAKDAGAEPPSMTQLLRR

SEQ ID NO: 36904 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKHGVSNKDIEKETAKDASGEPPSMTQLLRR

SEQ ID NO: 36905 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKHGVSNKDIEKETAKDASSEPPSMTQLLRR

SEQ ID NO: 36906 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKHGVSNKDIEKETAKDASAEPPSMTQLLRR

SEQ ID NO: 36907 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKHGVSNKDIEKETAKDAAGEPPSMTQLLRR

SEQ ID NO: 36908 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKHGVSNKDIEKETAKDAASEPPSMTQLLRR

SEQ ID NO: 36909 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKHGVSNKDIEKETAKDAAAEPPSMTQLLRR

SEQ ID NO: 36910 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKYGVSNKDIEKETAKDGGGEPPSMTQLLRR

SEQ ID NO: 36911 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKYGVSNKDIEKETAKDGGSEPPSMTQLLRR

SEQ ID NO: 36912 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKYGVSNKDIEKETAKDGGAEPPSMTQLLRR

SEQ ID NO: 36913 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKYGVSNKDIEKETAKDGSGEPPSMTQLLRR

SEQ ID NO: 36914 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKYGVSNKDIEKETAKDGSSEPPSMTQLLRR

SEQ ID NO: 36915 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKYGVSNKDIEKETAKDGSAEPPSMTQLLRR

SEQ ID NO: 36916 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKYGVSNKDIEKETAKDGAGEPPSMTQLLRR

SEQ ID NO: 36917 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKYGVSNKDIEKETAKDGASEPPSMTQLLRR

SEQ ID NO: 36918 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKYGVSNKDIEKETAKDGAAEPPSMTQLLRR

SEQ ID NO: 36919 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKYGVSNKDIEKETAKDSGGEPPSMTQLLRR

SEQ ID NO: 36920 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKYGVSNKDIEKETAKDSGSEPPSMTQLLRR

SEQ ID NO: 36921 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKYGVSNKDIEKETAKDSGAEPPSMTQLLRR

SEQ ID NO: 36922 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKYGVSNKDIEKETAKDSSGEPPSMTQLLRR

SEQ ID NO: 36923 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKYGVSNKDIEKETAKDSSSEPPSMTQLLRR

SEQ ID NO: 36924 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKYGVSNKDIEKETAKDSSAEPPSMTQLLRR

SEQ ID NO: 36925 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKYGVSNKDIEKETAKDSAGEPPSMTQLLRR

SEQ ID NO: 36926 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKYGVSNKDIEKETAKDSASEPPSMTQLLRR

SEQ ID NO: 36927 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKYGVSNKDIEKETAKDSAAEPPSMTQLLRR

SEQ ID NO: 36928 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKYGVSNKDIEKETAKDAGGEPPSMTQLLRR

SEQ ID NO: 36929 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKYGVSNKDIEKETAKDAGSEPPSMTQLLRR

SEQ ID NO: 36930 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKYGVSNKDIEKETAKDAGAEPPSMTQLLRR

SEQ ID NO: 36931 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKYGVSNKDIEKETAKDASGEPPSMTQLLRR

SEQ ID NO: 36932 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKYGVSNKDIEKETAKDASSEPPSMTQLLRR

SEQ ID NO: 36933 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKYGVSNKDIEKETAKDASAEPPSMTQLLRR

SEQ ID NO: 36934 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKYGVSNKDIEKETAKDAAGEPPSMTQLLRR

SEQ ID NO: 36935 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKYGVSNKDIEKETAKDAASEPPSMTQLLRR

SEQ ID NO: 36936 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKYGVSNKDIEKETAKDAAAEPPSMTQLLRR

SEQ ID NO: 36937 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKKGVSNKDIEKETAKDGGGEPPSMTQLLRR

SEQ ID NO: 36938 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKKGVSNKDIEKETAKDGGSEPPSMTQLLRR

SEQ ID NO: 36939 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKKGVSNKDIEKETAKDGGAEPPSMTQLLRR

SEQ ID NO: 36940 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKKGVSNKDIEKETAKDGSGEPPSMTQLLRR

SEQ ID NO: 36941 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKKGVSNKDIEKETAKDGSSEPPSMTQLLRR

SEQ ID NO: 36942 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKKGVSNKDIEKETAKDGSAEPPSMTQLLRR

SEQ ID NO: 36943 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKKGVSNKDIEKETAKDGAGEPPSMTQLLRR

SEQ ID NO: 36944 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKKGVSNKDIEKETAKDGASEPPSMTQLLRR

SEQ ID NO: 36945 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKKGVSNKDIEKETAKDGAAEPPSMTQLLRR

SEQ ID NO: 36946 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKKGVSNKDIEKETAKDSGGEPPSMTQLLRR

SEQ ID NO: 36947 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKKGVSNKDIEKETAKDSGSEPPSMTQLLRR

SEQ ID NO: 36948 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKKGVSNKDIEKETAKDSGAEPPSMTQLLRR

SEQ ID NO: 36949 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKKGVSNKDIEKETAKDSSGEPPSMTQLLRR

SEQ ID NO: 36950 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKKGVSNKDIEKETAKDSSSEPPSMTQLLRR

SEQ ID NO: 36951 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKKGVSNKDIEKETAKDSSAEPPSMTQLLRR

SEQ ID NO: 36952 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKKGVSNKDIEKETAKDSAGEPPSMTQLLRR

SEQ ID NO: 36953 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKKGVSNKDIEKETAKDSASEPPSMTQLLRR

SEQ ID NO: 36954 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKKGVSNKDIEKETAKDSAAEPPSMTQLLRR

SEQ ID NO: 36955 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKKGVSNKDIEKETAKDAGGEPPSMTQLLRR

SEQ ID NO: 36956 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKKGVSNKDIEKETAKDAGSEPPSMTQLLRR

SEQ ID NO: 36957 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKKGVSNKDIEKETAKDAGAEPPSMTQLLRR

SEQ ID NO: 36958 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKKGVSNKDIEKETAKDASGEPPSMTQLLRR

SEQ ID NO: 36959 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKKGVSNKDIEKETAKDASSEPPSMTQLLRR

SEQ ID NO: 36960 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKKGVSNKDIEKETAKDASAEPPSMTQLLRR

SEQ ID NO: 36961 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKKGVSNKDIEKETAKDAAGEPPSMTQLLRR

SEQ ID NO: 36962 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKKGVSNKDIEKETAKDAASEPPSMTQLLRR

SEQ ID NO: 36963 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKKGVSNKDIEKETAKDAAAEPPSMTQLLRR

SEQ ID NO: 36964 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKNGVSNKDIEKETAKDGGGEPPSMTQLLRR

SEQ ID NO: 36965 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKNGVSNKDIEKETAKDGGSEPPSMTQLLRR

SEQ ID NO: 36966 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKNGVSNKDIEKETAKDGGAEPPSMTQLLRR

SEQ ID NO: 36967 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKNGVSNKDIEKETAKDGSGEPPSMTQLLRR

SEQ ID NO: 36968 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKNGVSNKDIEKETAKDGSSEPPSMTQLLRR

SEQ ID NO: 36969 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKNGVSNKDIEKETAKDGSAEPPSMTQLLRR

SEQ ID NO: 36970 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKNGVSNKDIEKETAKDGAGEPPSMTQLLRR

SEQ ID NO: 36971 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKNGVSNKDIEKETAKDGASEPPSMTQLLRR

SEQ ID NO: 36972 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKNGVSNKDIEKETAKDGAAEPPSMTQLLRR

SEQ ID NO: 36973 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKNGVSNKDIEKETAKDSGGEPPSMTQLLRR

SEQ ID NO: 36974 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKNGVSNKDIEKETAKDSGSEPPSMTQLLRR

SEQ ID NO: 36975 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKNGVSNKDIEKETAKDSGAEPPSMTQLLRR

SEQ ID NO: 36976 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKNGVSNKDIEKETAKDSSGEPPSMTQLLRR

SEQ ID NO: 36977 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKNGVSNKDIEKETAKDSSSEPPSMTQLLRR

SEQ ID NO: 36978 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKNGVSNKDIEKETAKDSSAEPPSMTQLLRR

SEQ ID NO: 36979 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKNGVSNKDIEKETAKDSAGEPPSMTQLLRR

SEQ ID NO: 36980 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKNGVSNKDIEKETAKDSASEPPSMTQLLRR

SEQ ID NO: 36981 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKNGVSNKDIEKETAKDSAAEPPSMTQLLRR

SEQ ID NO: 36982 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKNGVSNKDIEKETAKDAGGEPPSMTQLLRR

SEQ ID NO: 36983 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKNGVSNKDIEKETAKDAGSEPPSMTQLLRR

SEQ ID NO: 36984 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKNGVSNKDIEKETAKDAGAEPPSMTQLLRR

SEQ ID NO: 36985 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKNGVSNKDIEKETAKDASGEPPSMTQLLRR

SEQ ID NO: 36986 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKNGVSNKDIEKETAKDASSEPPSMTQLLRR

SEQ ID NO: 36987 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKNGVSNKDIEKETAKDASAEPPSMTQLLRR

SEQ ID NO: 36988 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKNGVSNKDIEKETAKDAAGEPPSMTQLLRR

SEQ ID NO: 36989 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKNGVSNKDIEKETAKDAASEPPSMTQLLRR

SEQ ID NO: 36990 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKNGVSNKDIEKETAKDAAAEPPSMTQLLRR

SEQ ID NO: 36991 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKMGVSNKDIEKETAKDGGGEPPSMTQLLRR

SEQ ID NO: 36992 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKMGVSNKDIEKETAKDGGSEPPSMTQLLRR

SEQ ID NO: 36993 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKMGVSNKDIEKETAKDGGAEPPSMTQLLRR

SEQ ID NO: 36994 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKMGVSNKDIEKETAKDGSGEPPSMTQLLRR

SEQ ID NO: 36995 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKMGVSNKDIEKETAKDGSSEPPSMTQLLRR

SEQ ID NO: 36996 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKMGVSNKDIEKETAKDGSAEPPSMTQLLRR

SEQ ID NO: 36997 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKMGVSNKDIEKETAKDGAGEPPSMTQLLRR

SEQ ID NO: 36998 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKMGVSNKDIEKETAKDGASEPPSMTQLLRR

SEQ ID NO: 36999 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKMGVSNKDIEKETAKDGAAEPPSMTQLLRR

SEQ ID NO: 37000 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKMGVSNKDIEKETAKDSGGEPPSMTQLLRR

SEQ ID NO: 37001 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKMGVSNKDIEKETAKDSGSEPPSMTQLLRR

SEQ ID NO: 37002 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKMGVSNKDIEKETAKDSGAEPPSMTQLLRR

SEQ ID NO: 37003 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKMGVSNKDIEKETAKDSSGEPPSMTQLLRR

SEQ ID NO: 37004 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKMGVSNKDIEKETAKDSSSEPPSMTQLLRR

SEQ ID NO: 37005 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKMGVSNKDIEKETAKDSSAEPPSMTQLLRR

SEQ ID NO: 37006 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKMGVSNKDIEKETAKDSAGEPPSMTQLLRR

SEQ ID NO: 37007 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKMGVSNKDIEKETAKDSASEPPSMTQLLRR

SEQ ID NO: 37008 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKMGVSNKDIEKETAKDSAAEPPSMTQLLRR

SEQ ID NO: 37009 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKMGVSNKDIEKETAKDAGGEPPSMTQLLRR

SEQ ID NO: 37010 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKMGVSNKDIEKETAKDAGSEPPSMTQLLRR

SEQ ID NO: 37011 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKMGVSNKDIEKETAKDAGAEPPSMTQLLRR

SEQ ID NO: 37012 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKMGVSNKDIEKETAKDASGEPPSMTQLLRR

SEQ ID NO: 37013 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKMGVSNKDIEKETAKDASSEPPSMTQLLRR

SEQ ID NO: 37014 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKMGVSNKDIEKETAKDASAEPPSMTQLLRR

SEQ ID NO: 37015 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKMGVSNKDIEKETAKDAAGEPPSMTQLLRR

SEQ ID NO: 37016 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKMGVSNKDIEKETAKDAASEPPSMTQLLRR

SEQ ID NO: 37017 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKMGVSNKDIEKETAKDAAAEPPSMTQLLRR

SEQ ID NO: 37018 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKCGVSNKDIEKETAKDGGGEPPSMTQLLRR

SEQ ID NO: 37019 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKCGVSNKDIEKETAKDGGSEPPSMTQLLRR

SEQ ID NO: 37020 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKCGVSNKDIEKETAKDGGAEPPSMTQLLRR

SEQ ID NO: 37021 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKCGVSNKDIEKETAKDGSGEPPSMTQLLRR

SEQ ID NO: 37022 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKCGVSNKDIEKETAKDGSSEPPSMTQLLRR

SEQ ID NO: 37023 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKCGVSNKDIEKETAKDGSAEPPSMTQLLRR

SEQ ID NO: 37024 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKCGVSNKDIEKETAKDGAGEPPSMTQLLRR

SEQ ID NO: 37025 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKCGVSNKDIEKETAKDGASEPPSMTQLLRR

SEQ ID NO: 37026 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKCGVSNKDIEKETAKDGAAEPPSMTQLLRR

SEQ ID NO: 37027 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKCGVSNKDIEKETAKDSGGEPPSMTQLLRR

SEQ ID NO: 37028 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKCGVSNKDIEKETAKDSGSEPPSMTQLLRR

SEQ ID NO: 37029 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKCGVSNKDIEKETAKDSGAEPPSMTQLLRR

SEQ ID NO: 37030 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKCGVSNKDIEKETAKDSSGEPPSMTQLLRR

SEQ ID NO: 37031 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKCGVSNKDIEKETAKDSSSEPPSMTQLLRR

SEQ ID NO: 37032 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKCGVSNKDIEKETAKDSSAEPPSMTQLLRR

SEQ ID NO: 37033 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKCGVSNKDIEKETAKDSAGEPPSMTQLLRR

SEQ ID NO: 37034 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKCGVSNKDIEKETAKDSASEPPSMTQLLRR

SEQ ID NO: 37035 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKCGVSNKDIEKETAKDSAAEPPSMTQLLRR

SEQ ID NO: 37036 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKCGVSNKDIEKETAKDAGGEPPSMTQLLRR

SEQ ID NO: 37037 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKCGVSNKDIEKETAKDAGSEPPSMTQLLRR

SEQ ID NO: 37038 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKCGVSNKDIEKETAKDAGAEPPSMTQLLRR

SEQ ID NO: 37039 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKCGVSNKDIEKETAKDASGEPPSMTQLLRR

SEQ ID NO: 37040 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKCGVSNKDIEKETAKDASSEPPSMTQLLRR

SEQ ID NO: 37041 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKCGVSNKDIEKETAKDASAEPPSMTQLLRR

SEQ ID NO: 37042 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKCGVSNKDIEKETAKDAAGEPPSMTQLLRR

SEQ ID NO: 37043 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKCGVSNKDIEKETAKDAASEPPSMTQLLRR

SEQ ID NO: 37044 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKCGVSNKDIEKETAKDAAAEPPSMTQLLRR

SEQ ID NO: 37045 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKSGVSNKDIEKETAKDGGGEPPSMTQLLRR

SEQ ID NO: 37046 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKSGVSNKDIEKETAKDGGSEPPSMTQLLRR

SEQ ID NO: 37047 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKSGVSNKDIEKETAKDGGAEPPSMTQLLRR

SEQ ID NO: 37048 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKSGVSNKDIEKETAKDGSGEPPSMTQLLRR

SEQ ID NO: 37049 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKSGVSNKDIEKETAKDGSSEPPSMTQLLRR

SEQ ID NO: 37050 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKSGVSNKDIEKETAKDGSAEPPSMTQLLRR

SEQ ID NO: 37051 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKSGVSNKDIEKETAKDGAGEPPSMTQLLRR

SEQ ID NO: 37052 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKSGVSNKDIEKETAKDGASEPPSMTQLLRR

SEQ ID NO: 37053 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKSGVSNKDIEKETAKDGAAEPPSMTQLLRR

SEQ ID NO: 37054 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKSGVSNKDIEKETAKDSGGEPPSMTQLLRR

SEQ ID NO: 37055 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKSGVSNKDIEKETAKDSGSEPPSMTQLLRR

SEQ ID NO: 37056 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKSGVSNKDIEKETAKDSGAEPPSMTQLLRR

SEQ ID NO: 37057 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKSGVSNKDIEKETAKDSSGEPPSMTQLLRR

SEQ ID NO: 37058 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKSGVSNKDIEKETAKDSSSEPPSMTQLLRR

SEQ ID NO: 37059 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKSGVSNKDIEKETAKDSSAEPPSMTQLLRR

SEQ ID NO: 37060 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKSGVSNKDIEKETAKDSAGEPPSMTQLLRR

SEQ ID NO: 37061 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKSGVSNKDIEKETAKDSASEPPSMTQLLRR

SEQ ID NO: 37062 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKSGVSNKDIEKETAKDSAAEPPSMTQLLRR

SEQ ID NO: 37063 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKSGVSNKDIEKETAKDAGGEPPSMTQLLRR

SEQ ID NO: 37064 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKSGVSNKDIEKETAKDAGSEPPSMTQLLRR

SEQ ID NO: 37065 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKSGVSNKDIEKETAKDAGAEPPSMTQLLRR

SEQ ID NO: 37066 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKSGVSNKDIEKETAKDASGEPPSMTQLLRR

SEQ ID NO: 37067 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKSGVSNKDIEKETAKDASSEPPSMTQLLRR

SEQ ID NO: 37068 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKSGVSNKDIEKETAKDASAEPPSMTQLLRR

SEQ ID NO: 37069 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKSGVSNKDIEKETAKDAAGEPPSMTQLLRR

SEQ ID NO: 37070 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKSGVSNKDIEKETAKDAASEPPSMTQLLRR

SEQ ID NO: 37071 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKSGVSNKDIEKETAKDAAAEPPSMTQLLRR

SEQ ID NO: 37072 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKAGVSNKDIEKETAKDGGGEPPSMTQLLRR

SEQ ID NO: 37073 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKAGVSNKDIEKETAKDGGSEPPSMTQLLRR

SEQ ID NO: 37074 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKAGVSNKDIEKETAKDGGAEPPSMTQLLRR

SEQ ID NO: 37075 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKAGVSNKDIEKETAKDGSGEPPSMTQLLRR

SEQ ID NO: 37076 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKAGVSNKDIEKETAKDGSSEPPSMTQLLRR

SEQ ID NO: 37077 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKAGVSNKDIEKETAKDGSAEPPSMTQLLRR

SEQ ID NO: 37078 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKAGVSNKDIEKETAKDGAGEPPSMTQLLRR

SEQ ID NO: 37079 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKAGVSNKDIEKETAKDGASEPPSMTQLLRR

SEQ ID NO: 37080 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKAGVSNKDIEKETAKDGAAEPPSMTQLLRR

SEQ ID NO: 37081 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKAGVSNKDIEKETAKDSGGEPPSMTQLLRR

SEQ ID NO: 37082 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKAGVSNKDIEKETAKDSGSEPPSMTQLLRR

SEQ ID NO: 37083 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKAGVSNKDIEKETAKDSGAEPPSMTQLLRR

SEQ ID NO: 37084 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKAGVSNKDIEKETAKDSSGEPPSMTQLLRR

SEQ ID NO: 37085 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKAGVSNKDIEKETAKDSSSEPPSMTQLLRR

SEQ ID NO: 37086 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKAGVSNKDIEKETAKDSSAEPPSMTQLLRR

SEQ ID NO: 37087 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKAGVSNKDIEKETAKDSAGEPPSMTQLLRR

SEQ ID NO: 37088 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKAGVSNKDIEKETAKDSASEPPSMTQLLRR

SEQ ID NO: 37089 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKAGVSNKDIEKETAKDSAAEPPSMTQLLRR

SEQ ID NO: 37090 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKAGVSNKDIEKETAKDAGGEPPSMTQLLRR

SEQ ID NO: 37091 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKAGVSNKDIEKETAKDAGSEPPSMTQLLRR

SEQ ID NO: 37092 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKAGVSNKDIEKETAKDAGAEPPSMTQLLRR

SEQ ID NO: 37093 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKAGVSNKDIEKETAKDASGEPPSMTQLLRR

SEQ ID NO: 37094 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKAGVSNKDIEKETAKDASSEPPSMTQLLRR

SEQ ID NO: 37095 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKAGVSNKDIEKETAKDASAEPPSMTQLLRR

SEQ ID NO: 37096 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKAGVSNKDIEKETAKDAAGEPPSMTQLLRR

SEQ ID NO: 37097 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKAGVSNKDIEKETAKDAASEPPSMTQLLRR

SEQ ID NO: 37098 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKAGVSNKDIEKETAKDAAAEPPSMTQLLRR

SEQ ID NO: 37099 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKGGVSNKDIEKETAKDGGGEPPSMTQLLRR

SEQ ID NO: 37100 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKGGVSNKDIEKETAKDGGSEPPSMTQLLRR

SEQ ID NO: 37101 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKGGVSNKDIEKETAKDGGAEPPSMTQLLRR

SEQ ID NO: 37102 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKGGVSNKDIEKETAKDGSGEPPSMTQLLRR

SEQ ID NO: 37103 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKGGVSNKDIEKETAKDGSSEPPSMTQLLRR

SEQ ID NO: 37104 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKGGVSNKDIEKETAKDGSAEPPSMTQLLRR

SEQ ID NO: 37105 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKGGVSNKDIEKETAKDGAGEPPSMTQLLRR

SEQ ID NO: 37106 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKGGVSNKDIEKETAKDGASEPPSMTQLLRR

SEQ ID NO: 37107 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKGGVSNKDIEKETAKDGAAEPPSMTQLLRR

SEQ ID NO: 37108 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKGGVSNKDIEKETAKDSGGEPPSMTQLLRR

SEQ ID NO: 37109 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKGGVSNKDIEKETAKDSGSEPPSMTQLLRR

SEQ ID NO: 37110 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKGGVSNKDIEKETAKDSGAEPPSMTQLLRR

SEQ ID NO: 37111 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKGGVSNKDIEKETAKDSSGEPPSMTQLLRR

SEQ ID NO: 37112 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKGGVSNKDIEKETAKDSSSEPPSMTQLLRR

SEQ ID NO: 37113 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKGGVSNKDIEKETAKDSSAEPPSMTQLLRR

SEQ ID NO: 37114 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKGGVSNKDIEKETAKDSAGEPPSMTQLLRR

SEQ ID NO: 37115 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKGGVSNKDIEKETAKDSASEPPSMTQLLRR

SEQ ID NO: 37116 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKGGVSNKDIEKETAKDSAAEPPSMTQLLRR

SEQ ID NO: 37117 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKGGVSNKDIEKETAKDAGGEPPSMTQLLRR

SEQ ID NO: 37118 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKGGVSNKDIEKETAKDAGSEPPSMTQLLRR

SEQ ID NO: 37119 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKGGVSNKDIEKETAKDAGAEPPSMTQLLRR

SEQ ID NO: 37120 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKGGVSNKDIEKETAKDASGEPPSMTQLLRR

SEQ ID NO: 37121 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKGGVSNKDIEKETAKDASSEPPSMTQLLRR

SEQ ID NO: 37122 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKGGVSNKDIEKETAKDASAEPPSMTQLLRR

SEQ ID NO: 37123 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKGGVSNKDIEKETAKDAAGEPPSMTQLLRR

SEQ ID NO: 37124 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKGGVSNKDIEKETAKDAASEPPSMTQLLRR

SEQ ID NO: 37125 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKGGVSNKDIEKETAKDAAAEPPSMTQLLRR

SEQ ID NO: 37126 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKDGVSNKDIEKETAKDGGGEPPSMTQLLRR

SEQ ID NO: 37127 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKDGVSNKDIEKETAKDGGSEPPSMTQLLRR

SEQ ID NO: 37128 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKDGVSNKDIEKETAKDGGAEPPSMTQLLRR

SEQ ID NO: 37129 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKDGVSNKDIEKETAKDGSGEPPSMTQLLRR

SEQ ID NO: 37130 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKDGVSNKDIEKETAKDGSSEPPSMTQLLRR

SEQ ID NO: 37131 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKDGVSNKDIEKETAKDGSAEPPSMTQLLRR

SEQ ID NO: 37132 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKDGVSNKDIEKETAKDGAGEPPSMTQLLRR

SEQ ID NO: 37133 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKDGVSNKDIEKETAKDGASEPPSMTQLLRR

SEQ ID NO: 37134 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKDGVSNKDIEKETAKDGAAEPPSMTQLLRR

SEQ ID NO: 37135 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKDGVSNKDIEKETAKDSGGEPPSMTQLLRR

SEQ ID NO: 37136 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKDGVSNKDIEKETAKDSGSEPPSMTQLLRR

SEQ ID NO: 37137 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKDGVSNKDIEKETAKDSGAEPPSMTQLLRR

SEQ ID NO: 37138 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKDGVSNKDIEKETAKDSSGEPPSMTQLLRR

SEQ ID NO: 37139 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKDGVSNKDIEKETAKDSSSEPPSMTQLLRR

SEQ ID NO: 37140 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKDGVSNKDIEKETAKDSSAEPPSMTQLLRR

SEQ ID NO: 37141 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKDGVSNKDIEKETAKDSAGEPPSMTQLLRR

SEQ ID NO: 37142 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKDGVSNKDIEKETAKDSASEPPSMTQLLRR

SEQ ID NO: 37143 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKDGVSNKDIEKETAKDSAAEPPSMTQLLRR

SEQ ID NO: 37144 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKDGVSNKDIEKETAKDAGGEPPSMTQLLRR

SEQ ID NO: 37145 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKDGVSNKDIEKETAKDAGSEPPSMTQLLRR

SEQ ID NO: 37146 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKDGVSNKDIEKETAKDAGAEPPSMTQLLRR

SEQ ID NO: 37147 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKDGVSNKDIEKETAKDASGEPPSMTQLLRR

SEQ ID NO: 37148 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKDGVSNKDIEKETAKDASSEPPSMTQLLRR

SEQ ID NO: 37149 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKDGVSNKDIEKETAKDASAEPPSMTQLLRR

SEQ ID NO: 37150 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKDGVSNKDIEKETAKDAAGEPPSMTQLLRR

SEQ ID NO: 37151 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKDGVSNKDIEKETAKDAASEPPSMTQLLRR

SEQ ID NO: 37152 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKDGVSNKDIEKETAKDAAAEPPSMTQLLRR

SEQ ID NO: 37153 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKHGVSNKDIEKETAKDGGGEPPSMTQLLRR

SEQ ID NO: 37154 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKHGVSNKDIEKETAKDGGSEPPSMTQLLRR

SEQ ID NO: 37155 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKHGVSNKDIEKETAKDGGAEPPSMTQLLRR

SEQ ID NO: 37156 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKHGVSNKDIEKETAKDGSGEPPSMTQLLRR

SEQ ID NO: 37157 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKHGVSNKDIEKETAKDGSSEPPSMTQLLRR

SEQ ID NO: 37158 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKHGVSNKDIEKETAKDGSAEPPSMTQLLRR

SEQ ID NO: 37159 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKHGVSNKDIEKETAKDGAGEPPSMTQLLRR

SEQ ID NO: 37160 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKHGVSNKDIEKETAKDGASEPPSMTQLLRR

SEQ ID NO: 37161 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKHGVSNKDIEKETAKDGAAEPPSMTQLLRR

SEQ ID NO: 37162 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKHGVSNKDIEKETAKDSGGEPPSMTQLLRR

SEQ ID NO: 37163 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKHGVSNKDIEKETAKDSGSEPPSMTQLLRR

SEQ ID NO: 37164 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKHGVSNKDIEKETAKDSGAEPPSMTQLLRR

SEQ ID NO: 37165 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKHGVSNKDIEKETAKDSSGEPPSMTQLLRR

SEQ ID NO: 37166 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKHGVSNKDIEKETAKDSSSEPPSMTQLLRR

SEQ ID NO: 37167 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKHGVSNKDIEKETAKDSSAEPPSMTQLLRR

SEQ ID NO: 37168 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKHGVSNKDIEKETAKDSAGEPPSMTQLLRR

SEQ ID NO: 37169 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKHGVSNKDIEKETAKDSASEPPSMTQLLRR

SEQ ID NO: 37170 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKHGVSNKDIEKETAKDSAAEPPSMTQLLRR

SEQ ID NO: 37171 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKHGVSNKDIEKETAKDAGGEPPSMTQLLRR

SEQ ID NO: 37172 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKHGVSNKDIEKETAKDAGSEPPSMTQLLRR

SEQ ID NO: 37173 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKHGVSNKDIEKETAKDAGAEPPSMTQLLRR

SEQ ID NO: 37174 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKHGVSNKDIEKETAKDASGEPPSMTQLLRR

SEQ ID NO: 37175 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKHGVSNKDIEKETAKDASSEPPSMTQLLRR

SEQ ID NO: 37176 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKHGVSNKDIEKETAKDASAEPPSMTQLLRR

SEQ ID NO: 37177 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKHGVSNKDIEKETAKDAAGEPPSMTQLLRR

SEQ ID NO: 37178 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKHGVSNKDIEKETAKDAASEPPSMTQLLRR

SEQ ID NO: 37179 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKHGVSNKDIEKETAKDAAAEPPSMTQLLRR

SEQ ID NO: 37180 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKYGVSNKDIEKETAKDGGGEPPSMTQLLRR

SEQ ID NO: 37181 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKYGVSNKDIEKETAKDGGSEPPSMTQLLRR

SEQ ID NO: 37182 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKYGVSNKDIEKETAKDGGAEPPSMTQLLRR

SEQ ID NO: 37183 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKYGVSNKDIEKETAKDGSGEPPSMTQLLRR

SEQ ID NO: 37184 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKYGVSNKDIEKETAKDGSSEPPSMTQLLRR

SEQ ID NO: 37185 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKYGVSNKDIEKETAKDGSAEPPSMTQLLRR

SEQ ID NO: 37186 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKYGVSNKDIEKETAKDGAGEPPSMTQLLRR

SEQ ID NO: 37187 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKYGVSNKDIEKETAKDGASEPPSMTQLLRR

SEQ ID NO: 37188 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKYGVSNKDIEKETAKDGAAEPPSMTQLLRR

SEQ ID NO: 37189 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKYGVSNKDIEKETAKDSGGEPPSMTQLLRR

SEQ ID NO: 37190 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKYGVSNKDIEKETAKDSGSEPPSMTQLLRR

SEQ ID NO: 37191 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKYGVSNKDIEKETAKDSGAEPPSMTQLLRR

SEQ ID NO: 37192 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKYGVSNKDIEKETAKDSSGEPPSMTQLLRR

SEQ ID NO: 37193 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKYGVSNKDIEKETAKDSSSEPPSMTQLLRR

SEQ ID NO: 37194 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKYGVSNKDIEKETAKDSSAEPPSMTQLLRR

SEQ ID NO: 37195 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKYGVSNKDIEKETAKDSAGEPPSMTQLLRR

SEQ ID NO: 37196 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKYGVSNKDIEKETAKDSASEPPSMTQLLRR

SEQ ID NO: 37197 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKYGVSNKDIEKETAKDSAAEPPSMTQLLRR

SEQ ID NO: 37198 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKYGVSNKDIEKETAKDAGGEPPSMTQLLRR

SEQ ID NO: 37199 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKYGVSNKDIEKETAKDAGSEPPSMTQLLRR

SEQ ID NO: 37200 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKYGVSNKDIEKETAKDAGAEPPSMTQLLRR

SEQ ID NO: 37201 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKYGVSNKDIEKETAKDASGEPPSMTQLLRR

SEQ ID NO: 37202 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKYGVSNKDIEKETAKDASSEPPSMTQLLRR

SEQ ID NO: 37203 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKYGVSNKDIEKETAKDASAEPPSMTQLLRR

SEQ ID NO: 37204 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKYGVSNKDIEKETAKDAAGEPPSMTQLLRR

SEQ ID NO: 37205 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKYGVSNKDIEKETAKDAASEPPSMTQLLRR

SEQ ID NO: 37206 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKYGVSNKDIEKETAKDAAAEPPSMTQLLRR

SEQ ID NO: 37207 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKKGVSNKDIEKETAKDGGGEPPSMTQLLRR

SEQ ID NO: 37208 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKKGVSNKDIEKETAKDGGSEPPSMTQLLRR

SEQ ID NO: 37209 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKKGVSNKDIEKETAKDGGAEPPSMTQLLRR

SEQ ID NO: 37210 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKKGVSNKDIEKETAKDGSGEPPSMTQLLRR

SEQ ID NO: 37211 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKKGVSNKDIEKETAKDGSSEPPSMTQLLRR

SEQ ID NO: 37212 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKKGVSNKDIEKETAKDGSAEPPSMTQLLRR

SEQ ID NO: 37213 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKKGVSNKDIEKETAKDGAGEPPSMTQLLRR

SEQ ID NO: 37214 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKKGVSNKDIEKETAKDGASEPPSMTQLLRR

SEQ ID NO: 37215 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKKGVSNKDIEKETAKDGAAEPPSMTQLLRR

SEQ ID NO: 37216 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKKGVSNKDIEKETAKDSGGEPPSMTQLLRR

SEQ ID NO: 37217 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKKGVSNKDIEKETAKDSGSEPPSMTQLLRR

SEQ ID NO: 37218 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKKGVSNKDIEKETAKDSGAEPPSMTQLLRR

SEQ ID NO: 37219 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKKGVSNKDIEKETAKDSSGEPPSMTQLLRR

SEQ ID NO: 37220 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKKGVSNKDIEKETAKDSSSEPPSMTQLLRR

SEQ ID NO: 37221 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKKGVSNKDIEKETAKDSSAEPPSMTQLLRR

SEQ ID NO: 37222 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKKGVSNKDIEKETAKDSAGEPPSMTQLLRR

SEQ ID NO: 37223 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKKGVSNKDIEKETAKDSASEPPSMTQLLRR

SEQ ID NO: 37224 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKKGVSNKDIEKETAKDSAAEPPSMTQLLRR

SEQ ID NO: 37225 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKKGVSNKDIEKETAKDAGGEPPSMTQLLRR

SEQ ID NO: 37226 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKKGVSNKDIEKETAKDAGSEPPSMTQLLRR

SEQ ID NO: 37227 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKKGVSNKDIEKETAKDAGAEPPSMTQLLRR

SEQ ID NO: 37228 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKKGVSNKDIEKETAKDASGEPPSMTQLLRR

SEQ ID NO: 37229 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKKGVSNKDIEKETAKDASSEPPSMTQLLRR

SEQ ID NO: 37230 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKKGVSNKDIEKETAKDASAEPPSMTQLLRR

SEQ ID NO: 37231 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKKGVSNKDIEKETAKDAAGEPPSMTQLLRR

SEQ ID NO: 37232 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKKGVSNKDIEKETAKDAASEPPSMTQLLRR

SEQ ID NO: 37233 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKKGVSNKDIEKETAKDAAAEPPSMTQLLRR

SEQ ID NO: 37234 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKNGVSNKDIEKETAKDGGGEPPSMTQLLRR

SEQ ID NO: 37235 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKNGVSNKDIEKETAKDGGSEPPSMTQLLRR

SEQ ID NO: 37236 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKNGVSNKDIEKETAKDGGAEPPSMTQLLRR

SEQ ID NO: 37237 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKNGVSNKDIEKETAKDGSGEPPSMTQLLRR

SEQ ID NO: 37238 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKNGVSNKDIEKETAKDGSSEPPSMTQLLRR

SEQ ID NO: 37239 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKNGVSNKDIEKETAKDGSAEPPSMTQLLRR

SEQ ID NO: 37240 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKNGVSNKDIEKETAKDGAGEPPSMTQLLRR

SEQ ID NO: 37241 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKNGVSNKDIEKETAKDGASEPPSMTQLLRR

SEQ ID NO: 37242 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKNGVSNKDIEKETAKDGAAEPPSMTQLLRR

SEQ ID NO: 37243 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKNGVSNKDIEKETAKDSGGEPPSMTQLLRR

SEQ ID NO: 37244 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKNGVSNKDIEKETAKDSGSEPPSMTQLLRR

SEQ ID NO: 37245 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKNGVSNKDIEKETAKDSGAEPPSMTQLLRR

SEQ ID NO: 37246 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKNGVSNKDIEKETAKDSSGEPPSMTQLLRR

SEQ ID NO: 37247 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKNGVSNKDIEKETAKDSSSEPPSMTQLLRR

SEQ ID NO: 37248 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKNGVSNKDIEKETAKDSSAEPPSMTQLLRR

SEQ ID NO: 37249 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKNGVSNKDIEKETAKDSAGEPPSMTQLLRR

SEQ ID NO: 37250 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKNGVSNKDIEKETAKDSASEPPSMTQLLRR

SEQ ID NO: 37251 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKNGVSNKDIEKETAKDSAAEPPSMTQLLRR

SEQ ID NO: 37252 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKNGVSNKDIEKETAKDAGGEPPSMTQLLRR

SEQ ID NO: 37253 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKNGVSNKDIEKETAKDAGSEPPSMTQLLRR

SEQ ID NO: 37254 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKNGVSNKDIEKETAKDAGAEPPSMTQLLRR

SEQ ID NO: 37255 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKNGVSNKDIEKETAKDASGEPPSMTQLLRR

SEQ ID NO: 37256 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKNGVSNKDIEKETAKDASSEPPSMTQLLRR

SEQ ID NO: 37257 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKNGVSNKDIEKETAKDASAEPPSMTQLLRR

SEQ ID NO: 37258 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKNGVSNKDIEKETAKDAAGEPPSMTQLLRR

SEQ ID NO: 37259 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKNGVSNKDIEKETAKDAASEPPSMTQLLRR

SEQ ID NO: 37260 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKNGVSNKDIEKETAKDAAAEPPSMTQLLRR

SEQ ID NO: 37261 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKMGVSNKDIEKETAKDGGGEPPSMTQLLRR

SEQ ID NO: 37262 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKMGVSNKDIEKETAKDGGSEPPSMTQLLRR

SEQ ID NO: 37263 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKMGVSNKDIEKETAKDGGAEPPSMTQLLRR

SEQ ID NO: 37264 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKMGVSNKDIEKETAKDGSGEPPSMTQLLRR

SEQ ID NO: 37265 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKMGVSNKDIEKETAKDGSSEPPSMTQLLRR

SEQ ID NO: 37266 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKMGVSNKDIEKETAKDGSAEPPSMTQLLRR

SEQ ID NO: 37267 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKMGVSNKDIEKETAKDGAGEPPSMTQLLRR

SEQ ID NO: 37268 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKMGVSNKDIEKETAKDGASEPPSMTQLLRR

SEQ ID NO: 37269 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKMGVSNKDIEKETAKDGAAEPPSMTQLLRR

SEQ ID NO: 37270 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKMGVSNKDIEKETAKDSGGEPPSMTQLLRR

SEQ ID NO: 37271 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKMGVSNKDIEKETAKDSGSEPPSMTQLLRR

SEQ ID NO: 37272 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKMGVSNKDIEKETAKDSGAEPPSMTQLLRR

SEQ ID NO: 37273 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKMGVSNKDIEKETAKDSSGEPPSMTQLLRR

SEQ ID NO: 37274 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKMGVSNKDIEKETAKDSSSEPPSMTQLLRR

SEQ ID NO: 37275 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKMGVSNKDIEKETAKDSSAEPPSMTQLLRR

SEQ ID NO: 37276 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKMGVSNKDIEKETAKDSAGEPPSMTQLLRR

SEQ ID NO: 37277 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKMGVSNKDIEKETAKDSASEPPSMTQLLRR

SEQ ID NO: 37278 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKMGVSNKDIEKETAKDSAAEPPSMTQLLRR

SEQ ID NO: 37279 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKMGVSNKDIEKETAKDAGGEPPSMTQLLRR

SEQ ID NO: 37280 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKMGVSNKDIEKETAKDAGSEPPSMTQLLRR

SEQ ID NO: 37281 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKMGVSNKDIEKETAKDAGAEPPSMTQLLRR

SEQ ID NO: 37282 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKMGVSNKDIEKETAKDASGEPPSMTQLLRR

SEQ ID NO: 37283 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKMGVSNKDIEKETAKDASSEPPSMTQLLRR

SEQ ID NO: 37284 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKMGVSNKDIEKETAKDASAEPPSMTQLLRR

SEQ ID NO: 37285 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKMGVSNKDIEKETAKDAAGEPPSMTQLLRR

SEQ ID NO: 37286 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKMGVSNKDIEKETAKDAASEPPSMTQLLRR

SEQ ID NO: 37287 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKMGVSNKDIEKETAKDAAAEPPSMTQLLRR

SEQ ID NO: 37288 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKCGVSNKDIEKETAKDGGGEPPSMTQLLRR

SEQ ID NO: 37289 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKCGVSNKDIEKETAKDGGSEPPSMTQLLRR

SEQ ID NO: 37290 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKCGVSNKDIEKETAKDGGAEPPSMTQLLRR

SEQ ID NO: 37291 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKCGVSNKDIEKETAKDGSGEPPSMTQLLRR

SEQ ID NO: 37292 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKCGVSNKDIEKETAKDGSSEPPSMTQLLRR

SEQ ID NO: 37293 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKCGVSNKDIEKETAKDGSAEPPSMTQLLRR

SEQ ID NO: 37294 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKCGVSNKDIEKETAKDGAGEPPSMTQLLRR

SEQ ID NO: 37295 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKCGVSNKDIEKETAKDGASEPPSMTQLLRR

SEQ ID NO: 37296 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKCGVSNKDIEKETAKDGAAEPPSMTQLLRR

SEQ ID NO: 37297 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKCGVSNKDIEKETAKDSGGEPPSMTQLLRR

SEQ ID NO: 37298 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKCGVSNKDIEKETAKDSGSEPPSMTQLLRR

SEQ ID NO: 37299 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKCGVSNKDIEKETAKDSGAEPPSMTQLLRR

SEQ ID NO: 37300 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKCGVSNKDIEKETAKDSSGEPPSMTQLLRR

SEQ ID NO: 37301 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKCGVSNKDIEKETAKDSSSEPPSMTQLLRR

SEQ ID NO: 37302 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKCGVSNKDIEKETAKDSSAEPPSMTQLLRR

SEQ ID NO: 37303 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKCGVSNKDIEKETAKDSAGEPPSMTQLLRR

SEQ ID NO: 37304 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKCGVSNKDIEKETAKDSASEPPSMTQLLRR

SEQ ID NO: 37305 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKCGVSNKDIEKETAKDSAAEPPSMTQLLRR

SEQ ID NO: 37306 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKCGVSNKDIEKETAKDAGGEPPSMTQLLRR

SEQ ID NO: 37307 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKCGVSNKDIEKETAKDAGSEPPSMTQLLRR

SEQ ID NO: 37308 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKCGVSNKDIEKETAKDAGAEPPSMTQLLRR

SEQ ID NO: 37309 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKCGVSNKDIEKETAKDASGEPPSMTQLLRR

SEQ ID NO: 37310 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKCGVSNKDIEKETAKDASSEPPSMTQLLRR

SEQ ID NO: 37311 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKCGVSNKDIEKETAKDASAEPPSMTQLLRR

SEQ ID NO: 37312 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKCGVSNKDIEKETAKDAAGEPPSMTQLLRR

SEQ ID NO: 37313 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKCGVSNKDIEKETAKDAASEPPSMTQLLRR

SEQ ID NO: 37314 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKCGVSNKDIEKETAKDAAAEPPSMTQLLRR

SEQ ID NO: 37315 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKSGVSNKDIEKETAKDGGGEPPSMTQLLRR

SEQ ID NO: 37316 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKSGVSNKDIEKETAKDGGSEPPSMTQLLRR

SEQ ID NO: 37317 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKSGVSNKDIEKETAKDGGAEPPSMTQLLRR

SEQ ID NO: 37318 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKSGVSNKDIEKETAKDGSGEPPSMTQLLRR

SEQ ID NO: 37319 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKSGVSNKDIEKETAKDGSSEPPSMTQLLRR

SEQ ID NO: 37320 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKSGVSNKDIEKETAKDGSAEPPSMTQLLRR

SEQ ID NO: 37321 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKSGVSNKDIEKETAKDGAGEPPSMTQLLRR

SEQ ID NO: 37322 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKSGVSNKDIEKETAKDGASEPPSMTQLLRR

SEQ ID NO: 37323 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKSGVSNKDIEKETAKDGAAEPPSMTQLLRR

SEQ ID NO: 37324 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKSGVSNKDIEKETAKDSGGEPPSMTQLLRR

SEQ ID NO: 37325 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKSGVSNKDIEKETAKDSGSEPPSMTQLLRR

SEQ ID NO: 37326 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKSGVSNKDIEKETAKDSGAEPPSMTQLLRR

SEQ ID NO: 37327 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKSGVSNKDIEKETAKDSSGEPPSMTQLLRR

SEQ ID NO: 37328 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKSGVSNKDIEKETAKDSSSEPPSMTQLLRR

SEQ ID NO: 37329 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKSGVSNKDIEKETAKDSSAEPPSMTQLLRR

SEQ ID NO: 37330 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKSGVSNKDIEKETAKDSAGEPPSMTQLLRR

SEQ ID NO: 37331 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKSGVSNKDIEKETAKDSASEPPSMTQLLRR

SEQ ID NO: 37332 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKSGVSNKDIEKETAKDSAAEPPSMTQLLRR

SEQ ID NO: 37333 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKSGVSNKDIEKETAKDAGGEPPSMTQLLRR

SEQ ID NO: 37334 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKSGVSNKDIEKETAKDAGSEPPSMTQLLRR

SEQ ID NO: 37335 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKSGVSNKDIEKETAKDAGAEPPSMTQLLRR

SEQ ID NO: 37336 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKSGVSNKDIEKETAKDASGEPPSMTQLLRR

SEQ ID NO: 37337 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKSGVSNKDIEKETAKDASSEPPSMTQLLRR

SEQ ID NO: 37338 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKSGVSNKDIEKETAKDASAEPPSMTQLLRR

SEQ ID NO: 37339 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKSGVSNKDIEKETAKDAAGEPPSMTQLLRR

SEQ ID NO: 37340 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKSGVSNKDIEKETAKDAASEPPSMTQLLRR

SEQ ID NO: 37341 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKSGVSNKDIEKETAKDAAAEPPSMTQLLRR

SEQ ID NO: 37342 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKAGVSNKDIEKETAKDGGGEPPSMTQLLRR

SEQ ID NO: 37343 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKAGVSNKDIEKETAKDGGSEPPSMTQLLRR

SEQ ID NO: 37344 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKAGVSNKDIEKETAKDGGAEPPSMTQLLRR

SEQ ID NO: 37345 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKAGVSNKDIEKETAKDGSGEPPSMTQLLRR

SEQ ID NO: 37346 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKAGVSNKDIEKETAKDGSSEPPSMTQLLRR

SEQ ID NO: 37347 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKAGVSNKDIEKETAKDGSAEPPSMTQLLRR

SEQ ID NO: 37348 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKAGVSNKDIEKETAKDGAGEPPSMTQLLRR

SEQ ID NO: 37349 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKAGVSNKDIEKETAKDGASEPPSMTQLLRR

SEQ ID NO: 37350 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKAGVSNKDIEKETAKDGAAEPPSMTQLLRR

SEQ ID NO: 37351 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKAGVSNKDIEKETAKDSGGEPPSMTQLLRR

SEQ ID NO: 37352 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKAGVSNKDIEKETAKDSGSEPPSMTQLLRR

SEQ ID NO: 37353 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKAGVSNKDIEKETAKDSGAEPPSMTQLLRR

SEQ ID NO: 37354 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKAGVSNKDIEKETAKDSSGEPPSMTQLLRR

SEQ ID NO: 37355 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKAGVSNKDIEKETAKDSSSEPPSMTQLLRR

SEQ ID NO: 37356 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKAGVSNKDIEKETAKDSSAEPPSMTQLLRR

SEQ ID NO: 37357 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKAGVSNKDIEKETAKDSAGEPPSMTQLLRR

SEQ ID NO: 37358 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKAGVSNKDIEKETAKDSASEPPSMTQLLRR

SEQ ID NO: 37359 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKAGVSNKDIEKETAKDSAAEPPSMTQLLRR

SEQ ID NO: 37360 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKAGVSNKDIEKETAKDAGGEPPSMTQLLRR

SEQ ID NO: 37361 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKAGVSNKDIEKETAKDAGSEPPSMTQLLRR

SEQ ID NO: 37362 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKAGVSNKDIEKETAKDAGAEPPSMTQLLRR

SEQ ID NO: 37363 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKAGVSNKDIEKETAKDASGEPPSMTQLLRR

SEQ ID NO: 37364 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKAGVSNKDIEKETAKDASSEPPSMTQLLRR

SEQ ID NO: 37365 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKAGVSNKDIEKETAKDASAEPPSMTQLLRR

SEQ ID NO: 37366 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKAGVSNKDIEKETAKDAAGEPPSMTQLLRR

SEQ ID NO: 37367 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKAGVSNKDIEKETAKDAASEPPSMTQLLRR

SEQ ID NO: 37368 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKAGVSNKDIEKETAKDAAAEPPSMTQLLRR

SEQ ID NO: 37369 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKGGVSNKDIEKETAKDGGGEPPSMTQLLRR

SEQ ID NO: 37370 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKGGVSNKDIEKETAKDGGSEPPSMTQLLRR

SEQ ID NO: 37371 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKGGVSNKDIEKETAKDGGAEPPSMTQLLRR

SEQ ID NO: 37372 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKGGVSNKDIEKETAKDGSGEPPSMTQLLRR

SEQ ID NO: 37373 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKGGVSNKDIEKETAKDGSSEPPSMTQLLRR

SEQ ID NO: 37374 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKGGVSNKDIEKETAKDGSAEPPSMTQLLRR

SEQ ID NO: 37375 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKGGVSNKDIEKETAKDGAGEPPSMTQLLRR

SEQ ID NO: 37376 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKGGVSNKDIEKETAKDGASEPPSMTQLLRR

SEQ ID NO: 37377 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKGGVSNKDIEKETAKDGAAEPPSMTQLLRR

SEQ ID NO: 37378 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKGGVSNKDIEKETAKDSGGEPPSMTQLLRR

SEQ ID NO: 37379 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKGGVSNKDIEKETAKDSGSEPPSMTQLLRR

SEQ ID NO: 37380 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKGGVSNKDIEKETAKDSGAEPPSMTQLLRR

SEQ ID NO: 37381 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKGGVSNKDIEKETAKDSSGEPPSMTQLLRR

SEQ ID NO: 37382 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKGGVSNKDIEKETAKDSSSEPPSMTQLLRR

SEQ ID NO: 37383 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKGGVSNKDIEKETAKDSSAEPPSMTQLLRR

SEQ ID NO: 37384 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKGGVSNKDIEKETAKDSAGEPPSMTQLLRR

SEQ ID NO: 37385 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKGGVSNKDIEKETAKDSASEPPSMTQLLRR

SEQ ID NO: 37386 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKGGVSNKDIEKETAKDSAAEPPSMTQLLRR

SEQ ID NO: 37387 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKGGVSNKDIEKETAKDAGGEPPSMTQLLRR

SEQ ID NO: 37388 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKGGVSNKDIEKETAKDAGSEPPSMTQLLRR

SEQ ID NO: 37389 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKGGVSNKDIEKETAKDAGAEPPSMTQLLRR

SEQ ID NO: 37390 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKGGVSNKDIEKETAKDASGEPPSMTQLLRR

SEQ ID NO: 37391 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKGGVSNKDIEKETAKDASSEPPSMTQLLRR

SEQ ID NO: 37392 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKGGVSNKDIEKETAKDASAEPPSMTQLLRR

SEQ ID NO: 37393 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKGGVSNKDIEKETAKDAAGEPPSMTQLLRR

SEQ ID NO: 37394 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKGGVSNKDIEKETAKDAASEPPSMTQLLRR

SEQ ID NO: 37395 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKGGVSNKDIEKETAKDAAAEPPSMTQLLRR

SEQ ID NO: 37396 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKDGVSNKDIEKETAKDGGGEPPSMTQLLRR

SEQ ID NO: 37397 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKDGVSNKDIEKETAKDGGSEPPSMTQLLRR

SEQ ID NO: 37398 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKDGVSNKDIEKETAKDGGAEPPSMTQLLRR

SEQ ID NO: 37399 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKDGVSNKDIEKETAKDGSGEPPSMTQLLRR

SEQ ID NO: 37400 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKDGVSNKDIEKETAKDGSSEPPSMTQLLRR

SEQ ID NO: 37401 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKDGVSNKDIEKETAKDGSAEPPSMTQLLRR

SEQ ID NO: 37402 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKDGVSNKDIEKETAKDGAGEPPSMTQLLRR

SEQ ID NO: 37403 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKDGVSNKDIEKETAKDGASEPPSMTQLLRR

SEQ ID NO: 37404 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKDGVSNKDIEKETAKDGAAEPPSMTQLLRR

SEQ ID NO: 37405 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKDGVSNKDIEKETAKDSGGEPPSMTQLLRR

SEQ ID NO: 37406 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKDGVSNKDIEKETAKDSGSEPPSMTQLLRR

SEQ ID NO: 37407 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKDGVSNKDIEKETAKDSGAEPPSMTQLLRR

SEQ ID NO: 37408 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKDGVSNKDIEKETAKDSSGEPPSMTQLLRR

SEQ ID NO: 37409 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKDGVSNKDIEKETAKDSSSEPPSMTQLLRR

SEQ ID NO: 37410 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKDGVSNKDIEKETAKDSSAEPPSMTQLLRR

SEQ ID NO: 37411 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKDGVSNKDIEKETAKDSAGEPPSMTQLLRR

SEQ ID NO: 37412 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKDGVSNKDIEKETAKDSASEPPSMTQLLRR

SEQ ID NO: 37413 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKDGVSNKDIEKETAKDSAAEPPSMTQLLRR

SEQ ID NO: 37414 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKDGVSNKDIEKETAKDAGGEPPSMTQLLRR

SEQ ID NO: 37415 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKDGVSNKDIEKETAKDAGSEPPSMTQLLRR

SEQ ID NO: 37416 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKDGVSNKDIEKETAKDAGAEPPSMTQLLRR

SEQ ID NO: 37417 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKDGVSNKDIEKETAKDASGEPPSMTQLLRR

SEQ ID NO: 37418 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKDGVSNKDIEKETAKDASSEPPSMTQLLRR

SEQ ID NO: 37419 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKDGVSNKDIEKETAKDASAEPPSMTQLLRR

SEQ ID NO: 37420 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKDGVSNKDIEKETAKDAAGEPPSMTQLLRR

SEQ ID NO: 37421 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKDGVSNKDIEKETAKDAASEPPSMTQLLRR

SEQ ID NO: 37422 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKDGVSNKDIEKETAKDAAAEPPSMTQLLRR

SEQ ID NO: 37423 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKHGVSNKDIEKETAKDGGGEPPSMTQLLRR

SEQ ID NO: 37424 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKHGVSNKDIEKETAKDGGSEPPSMTQLLRR

SEQ ID NO: 37425 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKHGVSNKDIEKETAKDGGAEPPSMTQLLRR

SEQ ID NO: 37426 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKHGVSNKDIEKETAKDGSGEPPSMTQLLRR

SEQ ID NO: 37427 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKHGVSNKDIEKETAKDGSSEPPSMTQLLRR

SEQ ID NO: 37428 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKHGVSNKDIEKETAKDGSAEPPSMTQLLRR

SEQ ID NO: 37429 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKHGVSNKDIEKETAKDGAGEPPSMTQLLRR

SEQ ID NO: 37430 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKHGVSNKDIEKETAKDGASEPPSMTQLLRR

SEQ ID NO: 37431 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKHGVSNKDIEKETAKDGAAEPPSMTQLLRR

SEQ ID NO: 37432 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKHGVSNKDIEKETAKDSGGEPPSMTQLLRR

SEQ ID NO: 37433 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKHGVSNKDIEKETAKDSGSEPPSMTQLLRR

SEQ ID NO: 37434 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKHGVSNKDIEKETAKDSGAEPPSMTQLLRR

SEQ ID NO: 37435 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKHGVSNKDIEKETAKDSSGEPPSMTQLLRR

SEQ ID NO: 37436 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKHGVSNKDIEKETAKDSSSEPPSMTQLLRR

SEQ ID NO: 37437 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKHGVSNKDIEKETAKDSSAEPPSMTQLLRR

SEQ ID NO: 37438 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKHGVSNKDIEKETAKDSAGEPPSMTQLLRR

SEQ ID NO: 37439 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKHGVSNKDIEKETAKDSASEPPSMTQLLRR

SEQ ID NO: 37440 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKHGVSNKDIEKETAKDSAAEPPSMTQLLRR

SEQ ID NO: 37441 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKHGVSNKDIEKETAKDAGGEPPSMTQLLRR

SEQ ID NO: 37442 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKHGVSNKDIEKETAKDAGSEPPSMTQLLRR

SEQ ID NO: 37443 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKHGVSNKDIEKETAKDAGAEPPSMTQLLRR

SEQ ID NO: 37444 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKHGVSNKDIEKETAKDASGEPPSMTQLLRR

SEQ ID NO: 37445 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKHGVSNKDIEKETAKDASSEPPSMTQLLRR

SEQ ID NO: 37446 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKHGVSNKDIEKETAKDASAEPPSMTQLLRR

SEQ ID NO: 37447 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKHGVSNKDIEKETAKDAAGEPPSMTQLLRR

SEQ ID NO: 37448 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKHGVSNKDIEKETAKDAASEPPSMTQLLRR

SEQ ID NO: 37449 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKHGVSNKDIEKETAKDAAAEPPSMTQLLRR

SEQ ID NO: 37450 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKYGVSNKDIEKETAKDGGGEPPSMTQLLRR

SEQ ID NO: 37451 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKYGVSNKDIEKETAKDGGSEPPSMTQLLRR

SEQ ID NO: 37452 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKYGVSNKDIEKETAKDGGAEPPSMTQLLRR

SEQ ID NO: 37453 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKYGVSNKDIEKETAKDGSGEPPSMTQLLRR

SEQ ID NO: 37454 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKYGVSNKDIEKETAKDGSSEPPSMTQLLRR

SEQ ID NO: 37455 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKYGVSNKDIEKETAKDGSAEPPSMTQLLRR

SEQ ID NO: 37456 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKYGVSNKDIEKETAKDGAGEPPSMTQLLRR

SEQ ID NO: 37457 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKYGVSNKDIEKETAKDGASEPPSMTQLLRR

SEQ ID NO: 37458 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKYGVSNKDIEKETAKDGAAEPPSMTQLLRR

SEQ ID NO: 37459 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKYGVSNKDIEKETAKDSGGEPPSMTQLLRR

SEQ ID NO: 37460 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKYGVSNKDIEKETAKDSGSEPPSMTQLLRR

SEQ ID NO: 37461 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKYGVSNKDIEKETAKDSGAEPPSMTQLLRR

SEQ ID NO: 37462 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKYGVSNKDIEKETAKDSSGEPPSMTQLLRR

SEQ ID NO: 37463 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKYGVSNKDIEKETAKDSSSEPPSMTQLLRR

SEQ ID NO: 37464 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKYGVSNKDIEKETAKDSSAEPPSMTQLLRR

SEQ ID NO: 37465 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKYGVSNKDIEKETAKDSAGEPPSMTQLLRR

SEQ ID NO: 37466 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKYGVSNKDIEKETAKDSASEPPSMTQLLRR

SEQ ID NO: 37467 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKYGVSNKDIEKETAKDSAAEPPSMTQLLRR

SEQ ID NO: 37468 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKYGVSNKDIEKETAKDAGGEPPSMTQLLRR

SEQ ID NO: 37469 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKYGVSNKDIEKETAKDAGSEPPSMTQLLRR

SEQ ID NO: 37470 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKYGVSNKDIEKETAKDAGAEPPSMTQLLRR

SEQ ID NO: 37471 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKYGVSNKDIEKETAKDASGEPPSMTQLLRR

SEQ ID NO: 37472 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKYGVSNKDIEKETAKDASSEPPSMTQLLRR

SEQ ID NO: 37473 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKYGVSNKDIEKETAKDASAEPPSMTQLLRR

SEQ ID NO: 37474 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKYGVSNKDIEKETAKDAAGEPPSMTQLLRR

SEQ ID NO: 37475 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKYGVSNKDIEKETAKDAASEPPSMTQLLRR

SEQ ID NO: 37476 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKYGVSNKDIEKETAKDAAAEPPSMTQLLRR

SEQ ID NO: 37477 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKKGVSNKDIEKETAKDGGGEPPSMTQLLRR

SEQ ID NO: 37478 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKKGVSNKDIEKETAKDGGSEPPSMTQLLRR

SEQ ID NO: 37479 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKKGVSNKDIEKETAKDGGAEPPSMTQLLRR

SEQ ID NO: 37480 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKKGVSNKDIEKETAKDGSGEPPSMTQLLRR

SEQ ID NO: 37481 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKKGVSNKDIEKETAKDGSSEPPSMTQLLRR

SEQ ID NO: 37482 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKKGVSNKDIEKETAKDGSAEPPSMTQLLRR

SEQ ID NO: 37483 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKKGVSNKDIEKETAKDGAGEPPSMTQLLRR

SEQ ID NO: 37484 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKKGVSNKDIEKETAKDGASEPPSMTQLLRR

SEQ ID NO: 37485 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKKGVSNKDIEKETAKDGAAEPPSMTQLLRR

SEQ ID NO: 37486 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKKGVSNKDIEKETAKDSGGEPPSMTQLLRR

SEQ ID NO: 37487 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKKGVSNKDIEKETAKDSGSEPPSMTQLLRR

SEQ ID NO: 37488 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKKGVSNKDIEKETAKDSGAEPPSMTQLLRR

SEQ ID NO: 37489 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKKGVSNKDIEKETAKDSSGEPPSMTQLLRR

SEQ ID NO: 37490 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKKGVSNKDIEKETAKDSSSEPPSMTQLLRR

SEQ ID NO: 37491 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKKGVSNKDIEKETAKDSSAEPPSMTQLLRR

SEQ ID NO: 37492 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKKGVSNKDIEKETAKDSAGEPPSMTQLLRR

SEQ ID NO: 37493 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKKGVSNKDIEKETAKDSASEPPSMTQLLRR

SEQ ID NO: 37494 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKKGVSNKDIEKETAKDSAAEPPSMTQLLRR

SEQ ID NO: 37495 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKKGVSNKDIEKETAKDAGGEPPSMTQLLRR

SEQ ID NO: 37496 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKKGVSNKDIEKETAKDAGSEPPSMTQLLRR

SEQ ID NO: 37497 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKKGVSNKDIEKETAKDAGAEPPSMTQLLRR

SEQ ID NO: 37498 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKKGVSNKDIEKETAKDASGEPPSMTQLLRR

SEQ ID NO: 37499 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKKGVSNKDIEKETAKDASSEPPSMTQLLRR

SEQ ID NO: 37500 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKKGVSNKDIEKETAKDASAEPPSMTQLLRR

SEQ ID NO: 37501 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKKGVSNKDIEKETAKDAAGEPPSMTQLLRR

SEQ ID NO: 37502 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKKGVSNKDIEKETAKDAASEPPSMTQLLRR

SEQ ID NO: 37503 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKKGVSNKDIEKETAKDAAAEPPSMTQLLRR

SEQ ID NO: 37504 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKNGVSNKDIEKETAKDGGGEPPSMTQLLRR

SEQ ID NO: 37505 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKNGVSNKDIEKETAKDGGSEPPSMTQLLRR

SEQ ID NO: 37506 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKNGVSNKDIEKETAKDGGAEPPSMTQLLRR

SEQ ID NO: 37507 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKNGVSNKDIEKETAKDGSGEPPSMTQLLRR

SEQ ID NO: 37508 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKNGVSNKDIEKETAKDGSSEPPSMTQLLRR

SEQ ID NO: 37509 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKNGVSNKDIEKETAKDGSAEPPSMTQLLRR

SEQ ID NO: 37510 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKNGVSNKDIEKETAKDGAGEPPSMTQLLRR

SEQ ID NO: 37511 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKNGVSNKDIEKETAKDGASEPPSMTQLLRR

SEQ ID NO: 37512 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKNGVSNKDIEKETAKDGAAEPPSMTQLLRR

SEQ ID NO: 37513 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKNGVSNKDIEKETAKDSGGEPPSMTQLLRR

SEQ ID NO: 37514 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKNGVSNKDIEKETAKDSGSEPPSMTQLLRR

SEQ ID NO: 37515 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKNGVSNKDIEKETAKDSGAEPPSMTQLLRR

SEQ ID NO: 37516 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKNGVSNKDIEKETAKDSSGEPPSMTQLLRR

SEQ ID NO: 37517 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKNGVSNKDIEKETAKDSSSEPPSMTQLLRR

SEQ ID NO: 37518 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKNGVSNKDIEKETAKDSSAEPPSMTQLLRR

SEQ ID NO: 37519 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKNGVSNKDIEKETAKDSAGEPPSMTQLLRR

SEQ ID NO: 37520 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKNGVSNKDIEKETAKDSASEPPSMTQLLRR

SEQ ID NO: 37521 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKNGVSNKDIEKETAKDSAAEPPSMTQLLRR

SEQ ID NO: 37522 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKNGVSNKDIEKETAKDAGGEPPSMTQLLRR

SEQ ID NO: 37523 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKNGVSNKDIEKETAKDAGSEPPSMTQLLRR

SEQ ID NO: 37524 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKNGVSNKDIEKETAKDAGAEPPSMTQLLRR

SEQ ID NO: 37525 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKNGVSNKDIEKETAKDASGEPPSMTQLLRR

SEQ ID NO: 37526 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKNGVSNKDIEKETAKDASSEPPSMTQLLRR

SEQ ID NO: 37527 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKNGVSNKDIEKETAKDASAEPPSMTQLLRR

SEQ ID NO: 37528 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKNGVSNKDIEKETAKDAAGEPPSMTQLLRR

SEQ ID NO: 37529 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKNGVSNKDIEKETAKDAASEPPSMTQLLRR

SEQ ID NO: 37530 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKNGVSNKDIEKETAKDAAAEPPSMTQLLRR

SEQ ID NO: 37531 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKMGVSNKDIEKETAKDGGGEPPSMTQLLRR

SEQ ID NO: 37532 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKMGVSNKDIEKETAKDGGSEPPSMTQLLRR

SEQ ID NO: 37533 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKMGVSNKDIEKETAKDGGAEPPSMTQLLRR

SEQ ID NO: 37534 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKMGVSNKDIEKETAKDGSGEPPSMTQLLRR

SEQ ID NO: 37535 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKMGVSNKDIEKETAKDGSSEPPSMTQLLRR

SEQ ID NO: 37536 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKMGVSNKDIEKETAKDGSAEPPSMTQLLRR

SEQ ID NO: 37537 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKMGVSNKDIEKETAKDGAGEPPSMTQLLRR

SEQ ID NO: 37538 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKMGVSNKDIEKETAKDGASEPPSMTQLLRR

SEQ ID NO: 37539 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKMGVSNKDIEKETAKDGAAEPPSMTQLLRR

SEQ ID NO: 37540 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKMGVSNKDIEKETAKDSGGEPPSMTQLLRR

SEQ ID NO: 37541 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKMGVSNKDIEKETAKDSGSEPPSMTQLLRR

SEQ ID NO: 37542 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKMGVSNKDIEKETAKDSGAEPPSMTQLLRR

SEQ ID NO: 37543 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKMGVSNKDIEKETAKDSSGEPPSMTQLLRR

SEQ ID NO: 37544 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKMGVSNKDIEKETAKDSSSEPPSMTQLLRR

SEQ ID NO: 37545 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKMGVSNKDIEKETAKDSSAEPPSMTQLLRR

SEQ ID NO: 37546 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKMGVSNKDIEKETAKDSAGEPPSMTQLLRR

SEQ ID NO: 37547 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKMGVSNKDIEKETAKDSASEPPSMTQLLRR

SEQ ID NO: 37548 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKMGVSNKDIEKETAKDSAAEPPSMTQLLRR

SEQ ID NO: 37549 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKMGVSNKDIEKETAKDAGGEPPSMTQLLRR

SEQ ID NO: 37550 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKMGVSNKDIEKETAKDAGSEPPSMTQLLRR

SEQ ID NO: 37551 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKMGVSNKDIEKETAKDAGAEPPSMTQLLRR

SEQ ID NO: 37552 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKMGVSNKDIEKETAKDASGEPPSMTQLLRR

SEQ ID NO: 37553 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKMGVSNKDIEKETAKDASSEPPSMTQLLRR

SEQ ID NO: 37554 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKMGVSNKDIEKETAKDASAEPPSMTQLLRR

SEQ ID NO: 37555 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKMGVSNKDIEKETAKDAAGEPPSMTQLLRR

SEQ ID NO: 37556 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKMGVSNKDIEKETAKDAASEPPSMTQLLRR

SEQ ID NO: 37557 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKMGVSNKDIEKETAKDAAAEPPSMTQLLRR

SEQ ID NO: 37558 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKCGVSNKDIEKETAKDGGGEPPSMTQLLRR

SEQ ID NO: 37559 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKCGVSNKDIEKETAKDGGSEPPSMTQLLRR

SEQ ID NO: 37560 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKCGVSNKDIEKETAKDGGAEPPSMTQLLRR

SEQ ID NO: 37561 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKCGVSNKDIEKETAKDGSGEPPSMTQLLRR

SEQ ID NO: 37562 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKCGVSNKDIEKETAKDGSSEPPSMTQLLRR

SEQ ID NO: 37563 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKCGVSNKDIEKETAKDGSAEPPSMTQLLRR

SEQ ID NO: 37564 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKCGVSNKDIEKETAKDGAGEPPSMTQLLRR

SEQ ID NO: 37565 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKCGVSNKDIEKETAKDGASEPPSMTQLLRR

SEQ ID NO: 37566 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKCGVSNKDIEKETAKDGAAEPPSMTQLLRR

SEQ ID NO: 37567 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKCGVSNKDIEKETAKDSGGEPPSMTQLLRR

SEQ ID NO: 37568 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKCGVSNKDIEKETAKDSGSEPPSMTQLLRR

SEQ ID NO: 37569 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKCGVSNKDIEKETAKDSGAEPPSMTQLLRR

SEQ ID NO: 37570 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKCGVSNKDIEKETAKDSSGEPPSMTQLLRR

SEQ ID NO: 37571 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKCGVSNKDIEKETAKDSSSEPPSMTQLLRR

SEQ ID NO: 37572 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKCGVSNKDIEKETAKDSSAEPPSMTQLLRR

SEQ ID NO: 37573 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKCGVSNKDIEKETAKDSAGEPPSMTQLLRR

SEQ ID NO: 37574 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKCGVSNKDIEKETAKDSASEPPSMTQLLRR

SEQ ID NO: 37575 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKCGVSNKDIEKETAKDSAAEPPSMTQLLRR

SEQ ID NO: 37576 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKCGVSNKDIEKETAKDAGGEPPSMTQLLRR

SEQ ID NO: 37577 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKCGVSNKDIEKETAKDAGSEPPSMTQLLRR

SEQ ID NO: 37578 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKCGVSNKDIEKETAKDAGAEPPSMTQLLRR

SEQ ID NO: 37579 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKCGVSNKDIEKETAKDASGEPPSMTQLLRR

SEQ ID NO: 37580 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKCGVSNKDIEKETAKDASSEPPSMTQLLRR

SEQ ID NO: 37581 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKCGVSNKDIEKETAKDASAEPPSMTQLLRR

SEQ ID NO: 37582 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKCGVSNKDIEKETAKDAAGEPPSMTQLLRR

SEQ ID NO: 37583 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKCGVSNKDIEKETAKDAASEPPSMTQLLRR

SEQ ID NO: 37584 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKCGVSNKDIEKETAKDAAAEPPSMTQLLRR

SEQ ID NO: 37585 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKSGVSNKDIEKETAKDGGGEPPSMTQLLRR

SEQ ID NO: 37586 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKSGVSNKDIEKETAKDGGSEPPSMTQLLRR

SEQ ID NO: 37587 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKSGVSNKDIEKETAKDGGAEPPSMTQLLRR

SEQ ID NO: 37588 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKSGVSNKDIEKETAKDGSGEPPSMTQLLRR

SEQ ID NO: 37589 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKSGVSNKDIEKETAKDGSSEPPSMTQLLRR

SEQ ID NO: 37590 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKSGVSNKDIEKETAKDGSAEPPSMTQLLRR

SEQ ID NO: 37591 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKSGVSNKDIEKETAKDGAGEPPSMTQLLRR

SEQ ID NO: 37592 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKSGVSNKDIEKETAKDGASEPPSMTQLLRR

SEQ ID NO: 37593 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKSGVSNKDIEKETAKDGAAEPPSMTQLLRR

SEQ ID NO: 37594 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKSGVSNKDIEKETAKDSGGEPPSMTQLLRR

SEQ ID NO: 37595 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKSGVSNKDIEKETAKDSGSEPPSMTQLLRR

SEQ ID NO: 37596 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKSGVSNKDIEKETAKDSGAEPPSMTQLLRR

SEQ ID NO: 37597 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKSGVSNKDIEKETAKDSSGEPPSMTQLLRR

SEQ ID NO: 37598 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKSGVSNKDIEKETAKDSSSEPPSMTQLLRR

SEQ ID NO: 37599 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKSGVSNKDIEKETAKDSSAEPPSMTQLLRR

SEQ ID NO: 37600 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKSGVSNKDIEKETAKDSAGEPPSMTQLLRR

SEQ ID NO: 37601 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKSGVSNKDIEKETAKDSASEPPSMTQLLRR

SEQ ID NO: 37602 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKSGVSNKDIEKETAKDSAAEPPSMTQLLRR

SEQ ID NO: 37603 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKSGVSNKDIEKETAKDAGGEPPSMTQLLRR

SEQ ID NO: 37604 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKSGVSNKDIEKETAKDAGSEPPSMTQLLRR

SEQ ID NO: 37605 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKSGVSNKDIEKETAKDAGAEPPSMTQLLRR

SEQ ID NO: 37606 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKSGVSNKDIEKETAKDASGEPPSMTQLLRR

SEQ ID NO: 37607 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKSGVSNKDIEKETAKDASSEPPSMTQLLRR

SEQ ID NO: 37608 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKSGVSNKDIEKETAKDASAEPPSMTQLLRR

SEQ ID NO: 37609 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKSGVSNKDIEKETAKDAAGEPPSMTQLLRR

SEQ ID NO: 37610 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKSGVSNKDIEKETAKDAASEPPSMTQLLRR

SEQ ID NO: 37611 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKSGVSNKDIEKETAKDAAAEPPSMTQLLRR

SEQ ID NO: 37612 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKAGVSNKDIEKETAKDGGGEPPSMTQLLRR

SEQ ID NO: 37613 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKAGVSNKDIEKETAKDGGSEPPSMTQLLRR

SEQ ID NO: 37614 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKAGVSNKDIEKETAKDGGAEPPSMTQLLRR

SEQ ID NO: 37615 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKAGVSNKDIEKETAKDGSGEPPSMTQLLRR

SEQ ID NO: 37616 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKAGVSNKDIEKETAKDGSSEPPSMTQLLRR

SEQ ID NO: 37617 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKAGVSNKDIEKETAKDGSAEPPSMTQLLRR

SEQ ID NO: 37618 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKAGVSNKDIEKETAKDGAGEPPSMTQLLRR

SEQ ID NO: 37619 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKAGVSNKDIEKETAKDGASEPPSMTQLLRR

SEQ ID NO: 37620 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKAGVSNKDIEKETAKDGAAEPPSMTQLLRR

SEQ ID NO: 37621 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKAGVSNKDIEKETAKDSGGEPPSMTQLLRR

SEQ ID NO: 37622 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKAGVSNKDIEKETAKDSGSEPPSMTQLLRR

SEQ ID NO: 37623 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKAGVSNKDIEKETAKDSGAEPPSMTQLLRR

SEQ ID NO: 37624 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKAGVSNKDIEKETAKDSSGEPPSMTQLLRR

SEQ ID NO: 37625 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKAGVSNKDIEKETAKDSSSEPPSMTQLLRR

SEQ ID NO: 37626 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKAGVSNKDIEKETAKDSSAEPPSMTQLLRR

SEQ ID NO: 37627 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKAGVSNKDIEKETAKDSAGEPPSMTQLLRR

SEQ ID NO: 37628 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKAGVSNKDIEKETAKDSASEPPSMTQLLRR

SEQ ID NO: 37629 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKAGVSNKDIEKETAKDSAAEPPSMTQLLRR

SEQ ID NO: 37630 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKAGVSNKDIEKETAKDAGGEPPSMTQLLRR

SEQ ID NO: 37631 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKAGVSNKDIEKETAKDAGSEPPSMTQLLRR

SEQ ID NO: 37632 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKAGVSNKDIEKETAKDAGAEPPSMTQLLRR

SEQ ID NO: 37633 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKAGVSNKDIEKETAKDASGEPPSMTQLLRR

SEQ ID NO: 37634 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKAGVSNKDIEKETAKDASSEPPSMTQLLRR

SEQ ID NO: 37635 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKAGVSNKDIEKETAKDASAEPPSMTQLLRR

SEQ ID NO: 37636 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKAGVSNKDIEKETAKDAAGEPPSMTQLLRR

SEQ ID NO: 37637 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKAGVSNKDIEKETAKDAASEPPSMTQLLRR

SEQ ID NO: 37638 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKAGVSNKDIEKETAKDAAAEPPSMTQLLRR

SEQ ID NO: 37639 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKGGVSNKDIEKETAKDGGGEPPSMTQLLRR

SEQ ID NO: 37640 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKGGVSNKDIEKETAKDGGSEPPSMTQLLRR

SEQ ID NO: 37641 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKGGVSNKDIEKETAKDGGAEPPSMTQLLRR

SEQ ID NO: 37642 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKGGVSNKDIEKETAKDGSGEPPSMTQLLRR

SEQ ID NO: 37643 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKGGVSNKDIEKETAKDGSSEPPSMTQLLRR

SEQ ID NO: 37644 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKGGVSNKDIEKETAKDGSAEPPSMTQLLRR

SEQ ID NO: 37645 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKGGVSNKDIEKETAKDGAGEPPSMTQLLRR

SEQ ID NO: 37646 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKGGVSNKDIEKETAKDGASEPPSMTQLLRR

SEQ ID NO: 37647 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKGGVSNKDIEKETAKDGAAEPPSMTQLLRR

SEQ ID NO: 37648 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKGGVSNKDIEKETAKDSGGEPPSMTQLLRR

SEQ ID NO: 37649 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKGGVSNKDIEKETAKDSGSEPPSMTQLLRR

SEQ ID NO: 37650 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKGGVSNKDIEKETAKDSGAEPPSMTQLLRR

SEQ ID NO: 37651 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKGGVSNKDIEKETAKDSSGEPPSMTQLLRR

SEQ ID NO: 37652 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKGGVSNKDIEKETAKDSSSEPPSMTQLLRR

SEQ ID NO: 37653 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKGGVSNKDIEKETAKDSSAEPPSMTQLLRR

SEQ ID NO: 37654 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKGGVSNKDIEKETAKDSAGEPPSMTQLLRR

SEQ ID NO: 37655 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKGGVSNKDIEKETAKDSASEPPSMTQLLRR

SEQ ID NO: 37656 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKGGVSNKDIEKETAKDSAAEPPSMTQLLRR

SEQ ID NO: 37657 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKGGVSNKDIEKETAKDAGGEPPSMTQLLRR

SEQ ID NO: 37658 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKGGVSNKDIEKETAKDAGSEPPSMTQLLRR

SEQ ID NO: 37659 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKGGVSNKDIEKETAKDAGAEPPSMTQLLRR

SEQ ID NO: 37660 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKGGVSNKDIEKETAKDASGEPPSMTQLLRR

SEQ ID NO: 37661 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKGGVSNKDIEKETAKDASSEPPSMTQLLRR

SEQ ID NO: 37662 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKGGVSNKDIEKETAKDASAEPPSMTQLLRR

SEQ ID NO: 37663 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKGGVSNKDIEKETAKDAAGEPPSMTQLLRR

SEQ ID NO: 37664 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKGGVSNKDIEKETAKDAASEPPSMTQLLRR

SEQ ID NO: 37665 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKGGVSNKDIEKETAKDAAAEPPSMTQLLRR

SEQ ID NO: 37666 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKDGVSNKDIEKETAKDGGGEPPSMTQLLRR

SEQ ID NO: 37667 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKDGVSNKDIEKETAKDGGSEPPSMTQLLRR

SEQ ID NO: 37668 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKDGVSNKDIEKETAKDGGAEPPSMTQLLRR

SEQ ID NO: 37669 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKDGVSNKDIEKETAKDGSGEPPSMTQLLRR

SEQ ID NO: 37670 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKDGVSNKDIEKETAKDGSSEPPSMTQLLRR

SEQ ID NO: 37671 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKDGVSNKDIEKETAKDGSAEPPSMTQLLRR

SEQ ID NO: 37672 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKDGVSNKDIEKETAKDGAGEPPSMTQLLRR

SEQ ID NO: 37673 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKDGVSNKDIEKETAKDGASEPPSMTQLLRR

SEQ ID NO: 37674 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKDGVSNKDIEKETAKDGAAEPPSMTQLLRR

SEQ ID NO: 37675 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKDGVSNKDIEKETAKDSGGEPPSMTQLLRR

SEQ ID NO: 37676 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKDGVSNKDIEKETAKDSGSEPPSMTQLLRR

SEQ ID NO: 37677 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKDGVSNKDIEKETAKDSGAEPPSMTQLLRR

SEQ ID NO: 37678 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKDGVSNKDIEKETAKDSSGEPPSMTQLLRR

SEQ ID NO: 37679 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKDGVSNKDIEKETAKDSSSEPPSMTQLLRR

SEQ ID NO: 37680 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKDGVSNKDIEKETAKDSSAEPPSMTQLLRR

SEQ ID NO: 37681 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKDGVSNKDIEKETAKDSAGEPPSMTQLLRR

SEQ ID NO: 37682 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKDGVSNKDIEKETAKDSASEPPSMTQLLRR

SEQ ID NO: 37683 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKDGVSNKDIEKETAKDSAAEPPSMTQLLRR

SEQ ID NO: 37684 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKDGVSNKDIEKETAKDAGGEPPSMTQLLRR

SEQ ID NO: 37685 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKDGVSNKDIEKETAKDAGSEPPSMTQLLRR

SEQ ID NO: 37686 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKDGVSNKDIEKETAKDAGAEPPSMTQLLRR

SEQ ID NO: 37687 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKDGVSNKDIEKETAKDASGEPPSMTQLLRR

SEQ ID NO: 37688 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKDGVSNKDIEKETAKDASSEPPSMTQLLRR

SEQ ID NO: 37689 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKDGVSNKDIEKETAKDASAEPPSMTQLLRR

SEQ ID NO: 37690 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKDGVSNKDIEKETAKDAAGEPPSMTQLLRR

SEQ ID NO: 37691 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKDGVSNKDIEKETAKDAASEPPSMTQLLRR

SEQ ID NO: 37692 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKDGVSNKDIEKETAKDAAAEPPSMTQLLRR

SEQ ID NO: 37693 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKHGVSNKDIEKETAKDGGGEPPSMTQLLRR

SEQ ID NO: 37694 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKHGVSNKDIEKETAKDGGSEPPSMTQLLRR

SEQ ID NO: 37695 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKHGVSNKDIEKETAKDGGAEPPSMTQLLRR

SEQ ID NO: 37696 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKHGVSNKDIEKETAKDGSGEPPSMTQLLRR

SEQ ID NO: 37697 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKHGVSNKDIEKETAKDGSSEPPSMTQLLRR

SEQ ID NO: 37698 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKHGVSNKDIEKETAKDGSAEPPSMTQLLRR

SEQ ID NO: 37699 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKHGVSNKDIEKETAKDGAGEPPSMTQLLRR

SEQ ID NO: 37700 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKHGVSNKDIEKETAKDGASEPPSMTQLLRR

SEQ ID NO: 37701 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKHGVSNKDIEKETAKDGAAEPPSMTQLLRR

SEQ ID NO: 37702 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKHGVSNKDIEKETAKDSGGEPPSMTQLLRR

SEQ ID NO: 37703 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKHGVSNKDIEKETAKDSGSEPPSMTQLLRR

SEQ ID NO: 37704 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKHGVSNKDIEKETAKDSGAEPPSMTQLLRR

SEQ ID NO: 37705 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKHGVSNKDIEKETAKDSSGEPPSMTQLLRR

SEQ ID NO: 37706 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKHGVSNKDIEKETAKDSSSEPPSMTQLLRR

SEQ ID NO: 37707 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKHGVSNKDIEKETAKDSSAEPPSMTQLLRR

SEQ ID NO: 37708 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKHGVSNKDIEKETAKDSAGEPPSMTQLLRR

SEQ ID NO: 37709 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKHGVSNKDIEKETAKDSASEPPSMTQLLRR

SEQ ID NO: 37710 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKHGVSNKDIEKETAKDSAAEPPSMTQLLRR

SEQ ID NO: 37711 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKHGVSNKDIEKETAKDAGGEPPSMTQLLRR

SEQ ID NO: 37712 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKHGVSNKDIEKETAKDAGSEPPSMTQLLRR

SEQ ID NO: 37713 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKHGVSNKDIEKETAKDAGAEPPSMTQLLRR

SEQ ID NO: 37714 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKHGVSNKDIEKETAKDASGEPPSMTQLLRR

SEQ ID NO: 37715 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKHGVSNKDIEKETAKDASSEPPSMTQLLRR

SEQ ID NO: 37716 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKHGVSNKDIEKETAKDASAEPPSMTQLLRR

SEQ ID NO: 37717 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKHGVSNKDIEKETAKDAAGEPPSMTQLLRR

SEQ ID NO: 37718 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKHGVSNKDIEKETAKDAASEPPSMTQLLRR

SEQ ID NO: 37719 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKHGVSNKDIEKETAKDAAAEPPSMTQLLRR

SEQ ID NO: 37720 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKYGVSNKDIEKETAKDGGGEPPSMTQLLRR

SEQ ID NO: 37721 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKYGVSNKDIEKETAKDGGSEPPSMTQLLRR

SEQ ID NO: 37722 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKYGVSNKDIEKETAKDGGAEPPSMTQLLRR

SEQ ID NO: 37723 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKYGVSNKDIEKETAKDGSGEPPSMTQLLRR

SEQ ID NO: 37724 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKYGVSNKDIEKETAKDGSSEPPSMTQLLRR

SEQ ID NO: 37725 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKYGVSNKDIEKETAKDGSAEPPSMTQLLRR

SEQ ID NO: 37726 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKYGVSNKDIEKETAKDGAGEPPSMTQLLRR

SEQ ID NO: 37727 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKYGVSNKDIEKETAKDGASEPPSMTQLLRR

SEQ ID NO: 37728 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKYGVSNKDIEKETAKDGAAEPPSMTQLLRR

SEQ ID NO: 37729 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKYGVSNKDIEKETAKDSGGEPPSMTQLLRR

SEQ ID NO: 37730 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKYGVSNKDIEKETAKDSGSEPPSMTQLLRR

SEQ ID NO: 37731 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKYGVSNKDIEKETAKDSGAEPPSMTQLLRR

SEQ ID NO: 37732 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKYGVSNKDIEKETAKDSSGEPPSMTQLLRR

SEQ ID NO: 37733 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKYGVSNKDIEKETAKDSSSEPPSMTQLLRR

SEQ ID NO: 37734 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKYGVSNKDIEKETAKDSSAEPPSMTQLLRR

SEQ ID NO: 37735 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKYGVSNKDIEKETAKDSAGEPPSMTQLLRR

SEQ ID NO: 37736 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKYGVSNKDIEKETAKDSASEPPSMTQLLRR

SEQ ID NO: 37737 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKYGVSNKDIEKETAKDSAAEPPSMTQLLRR

SEQ ID NO: 37738 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKYGVSNKDIEKETAKDAGGEPPSMTQLLRR

SEQ ID NO: 37739 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKYGVSNKDIEKETAKDAGSEPPSMTQLLRR

SEQ ID NO: 37740 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKYGVSNKDIEKETAKDAGAEPPSMTQLLRR

SEQ ID NO: 37741 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKYGVSNKDIEKETAKDASGEPPSMTQLLRR

SEQ ID NO: 37742 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKYGVSNKDIEKETAKDASSEPPSMTQLLRR

SEQ ID NO: 37743 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKYGVSNKDIEKETAKDASAEPPSMTQLLRR

SEQ ID NO: 37744 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKYGVSNKDIEKETAKDAAGEPPSMTQLLRR

SEQ ID NO: 37745 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKYGVSNKDIEKETAKDAASEPPSMTQLLRR

SEQ ID NO: 37746 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKYGVSNKDIEKETAKDAAAEPPSMTQLLRR

SEQ ID NO: 37747 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKKGVSNKDIEKETAKDGGGEPPSMTQLLRR

SEQ ID NO: 37748 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKKGVSNKDIEKETAKDGGSEPPSMTQLLRR

SEQ ID NO: 37749 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKKGVSNKDIEKETAKDGGAEPPSMTQLLRR

SEQ ID NO: 37750 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKKGVSNKDIEKETAKDGSGEPPSMTQLLRR

SEQ ID NO: 37751 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKKGVSNKDIEKETAKDGSSEPPSMTQLLRR

SEQ ID NO: 37752 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKKGVSNKDIEKETAKDGSAEPPSMTQLLRR

SEQ ID NO: 37753 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKKGVSNKDIEKETAKDGAGEPPSMTQLLRR

SEQ ID NO: 37754 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKKGVSNKDIEKETAKDGASEPPSMTQLLRR

SEQ ID NO: 37755 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKKGVSNKDIEKETAKDGAAEPPSMTQLLRR

SEQ ID NO: 37756 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKKGVSNKDIEKETAKDSGGEPPSMTQLLRR

SEQ ID NO: 37757 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKKGVSNKDIEKETAKDSGSEPPSMTQLLRR

SEQ ID NO: 37758 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKKGVSNKDIEKETAKDSGAEPPSMTQLLRR

SEQ ID NO: 37759 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKKGVSNKDIEKETAKDSSGEPPSMTQLLRR

SEQ ID NO: 37760 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKKGVSNKDIEKETAKDSSSEPPSMTQLLRR

SEQ ID NO: 37761 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKKGVSNKDIEKETAKDSSAEPPSMTQLLRR

SEQ ID NO: 37762 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKKGVSNKDIEKETAKDSAGEPPSMTQLLRR

SEQ ID NO: 37763 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKKGVSNKDIEKETAKDSASEPPSMTQLLRR

SEQ ID NO: 37764 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKKGVSNKDIEKETAKDSAAEPPSMTQLLRR

SEQ ID NO: 37765 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKKGVSNKDIEKETAKDAGGEPPSMTQLLRR

SEQ ID NO: 37766 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKKGVSNKDIEKETAKDAGSEPPSMTQLLRR

SEQ ID NO: 37767 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKKGVSNKDIEKETAKDAGAEPPSMTQLLRR

SEQ ID NO: 37768 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKKGVSNKDIEKETAKDASGEPPSMTQLLRR

SEQ ID NO: 37769 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKKGVSNKDIEKETAKDASSEPPSMTQLLRR

SEQ ID NO: 37770 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKKGVSNKDIEKETAKDASAEPPSMTQLLRR

SEQ ID NO: 37771 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKKGVSNKDIEKETAKDAAGEPPSMTQLLRR

SEQ ID NO: 37772 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKKGVSNKDIEKETAKDAASEPPSMTQLLRR

SEQ ID NO: 37773 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKKGVSNKDIEKETAKDAAAEPPSMTQLLRR

SEQ ID NO: 37774 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKNGVSNKDIEKETAKDGGGEPPSMTQLLRR

SEQ ID NO: 37775 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKNGVSNKDIEKETAKDGGSEPPSMTQLLRR

SEQ ID NO: 37776 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKNGVSNKDIEKETAKDGGAEPPSMTQLLRR

SEQ ID NO: 37777 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKNGVSNKDIEKETAKDGSGEPPSMTQLLRR

SEQ ID NO: 37778 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKNGVSNKDIEKETAKDGSSEPPSMTQLLRR

SEQ ID NO: 37779 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKNGVSNKDIEKETAKDGSAEPPSMTQLLRR

SEQ ID NO: 37780 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKNGVSNKDIEKETAKDGAGEPPSMTQLLRR

SEQ ID NO: 37781 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKNGVSNKDIEKETAKDGASEPPSMTQLLRR

SEQ ID NO: 37782 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKNGVSNKDIEKETAKDGAAEPPSMTQLLRR

SEQ ID NO: 37783 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKNGVSNKDIEKETAKDSGGEPPSMTQLLRR

SEQ ID NO: 37784 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKNGVSNKDIEKETAKDSGSEPPSMTQLLRR

SEQ ID NO: 37785 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKNGVSNKDIEKETAKDSGAEPPSMTQLLRR

SEQ ID NO: 37786 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKNGVSNKDIEKETAKDSSGEPPSMTQLLRR

SEQ ID NO: 37787 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKNGVSNKDIEKETAKDSSSEPPSMTQLLRR

SEQ ID NO: 37788 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKNGVSNKDIEKETAKDSSAEPPSMTQLLRR

SEQ ID NO: 37789 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKNGVSNKDIEKETAKDSAGEPPSMTQLLRR

SEQ ID NO: 37790 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKNGVSNKDIEKETAKDSASEPPSMTQLLRR

SEQ ID NO: 37791 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKNGVSNKDIEKETAKDSAAEPPSMTQLLRR

SEQ ID NO: 37792 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKNGVSNKDIEKETAKDAGGEPPSMTQLLRR

SEQ ID NO: 37793 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKNGVSNKDIEKETAKDAGSEPPSMTQLLRR

SEQ ID NO: 37794 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKNGVSNKDIEKETAKDAGAEPPSMTQLLRR

SEQ ID NO: 37795 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKNGVSNKDIEKETAKDASGEPPSMTQLLRR

SEQ ID NO: 37796 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKNGVSNKDIEKETAKDASSEPPSMTQLLRR

SEQ ID NO: 37797 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKNGVSNKDIEKETAKDASAEPPSMTQLLRR

SEQ ID NO: 37798 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKNGVSNKDIEKETAKDAAGEPPSMTQLLRR

SEQ ID NO: 37799 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKNGVSNKDIEKETAKDAASEPPSMTQLLRR

SEQ ID NO: 37800 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKNGVSNKDIEKETAKDAAAEPPSMTQLLRR

SEQ ID NO: 37801 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKMGVSNKDIEKETAKDGGGEPPSMTQLLRR

SEQ ID NO: 37802 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKMGVSNKDIEKETAKDGGSEPPSMTQLLRR

SEQ ID NO: 37803 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKMGVSNKDIEKETAKDGGAEPPSMTQLLRR

SEQ ID NO: 37804 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKMGVSNKDIEKETAKDGSGEPPSMTQLLRR

SEQ ID NO: 37805 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKMGVSNKDIEKETAKDGSSEPPSMTQLLRR

SEQ ID NO: 37806 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKMGVSNKDIEKETAKDGSAEPPSMTQLLRR

SEQ ID NO: 37807 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKMGVSNKDIEKETAKDGAGEPPSMTQLLRR

SEQ ID NO: 37808 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKMGVSNKDIEKETAKDGASEPPSMTQLLRR

SEQ ID NO: 37809 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKMGVSNKDIEKETAKDGAAEPPSMTQLLRR

SEQ ID NO: 37810 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKMGVSNKDIEKETAKDSGGEPPSMTQLLRR

SEQ ID NO: 37811 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKMGVSNKDIEKETAKDSGSEPPSMTQLLRR

SEQ ID NO: 37812 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKMGVSNKDIEKETAKDSGAEPPSMTQLLRR

SEQ ID NO: 37813 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKMGVSNKDIEKETAKDSSGEPPSMTQLLRR

SEQ ID NO: 37814 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKMGVSNKDIEKETAKDSSSEPPSMTQLLRR

SEQ ID NO: 37815 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKMGVSNKDIEKETAKDSSAEPPSMTQLLRR

SEQ ID NO: 37816 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKMGVSNKDIEKETAKDSAGEPPSMTQLLRR

SEQ ID NO: 37817 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKMGVSNKDIEKETAKDSASEPPSMTQLLRR

SEQ ID NO: 37818 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKMGVSNKDIEKETAKDSAAEPPSMTQLLRR

SEQ ID NO: 37819 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKMGVSNKDIEKETAKDAGGEPPSMTQLLRR

SEQ ID NO: 37820 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKMGVSNKDIEKETAKDAGSEPPSMTQLLRR

SEQ ID NO: 37821 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKMGVSNKDIEKETAKDAGAEPPSMTQLLRR

SEQ ID NO: 37822 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKMGVSNKDIEKETAKDASGEPPSMTQLLRR

SEQ ID NO: 37823 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKMGVSNKDIEKETAKDASSEPPSMTQLLRR

SEQ ID NO: 37824 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKMGVSNKDIEKETAKDASAEPPSMTQLLRR

SEQ ID NO: 37825 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKMGVSNKDIEKETAKDAAGEPPSMTQLLRR

SEQ ID NO: 37826 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKMGVSNKDIEKETAKDAASEPPSMTQLLRR

SEQ ID NO: 37827 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKMGVSNKDIEKETAKDAAAEPPSMTQLLRR

SEQ ID NO: 37828 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKCGVSNKDIEKETAKDGGGEPPSMTQLLRR

SEQ ID NO: 37829 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKCGVSNKDIEKETAKDGGSEPPSMTQLLRR

SEQ ID NO: 37830 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKCGVSNKDIEKETAKDGGAEPPSMTQLLRR

SEQ ID NO: 37831 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKCGVSNKDIEKETAKDGSGEPPSMTQLLRR

SEQ ID NO: 37832 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKCGVSNKDIEKETAKDGSSEPPSMTQLLRR

SEQ ID NO: 37833 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKCGVSNKDIEKETAKDGSAEPPSMTQLLRR

SEQ ID NO: 37834 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKCGVSNKDIEKETAKDGAGEPPSMTQLLRR

SEQ ID NO: 37835 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKCGVSNKDIEKETAKDGASEPPSMTQLLRR

SEQ ID NO: 37836 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKCGVSNKDIEKETAKDGAAEPPSMTQLLRR

SEQ ID NO: 37837 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKCGVSNKDIEKETAKDSGGEPPSMTQLLRR

SEQ ID NO: 37838 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKCGVSNKDIEKETAKDSGSEPPSMTQLLRR

SEQ ID NO: 37839 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKCGVSNKDIEKETAKDSGAEPPSMTQLLRR

SEQ ID NO: 37840 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKCGVSNKDIEKETAKDSSGEPPSMTQLLRR

SEQ ID NO: 37841 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKCGVSNKDIEKETAKDSSSEPPSMTQLLRR

SEQ ID NO: 37842 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKCGVSNKDIEKETAKDSSAEPPSMTQLLRR

SEQ ID NO: 37843 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKCGVSNKDIEKETAKDSAGEPPSMTQLLRR

SEQ ID NO: 37844 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKCGVSNKDIEKETAKDSASEPPSMTQLLRR

SEQ ID NO: 37845 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKCGVSNKDIEKETAKDSAAEPPSMTQLLRR

SEQ ID NO: 37846 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKCGVSNKDIEKETAKDAGGEPPSMTQLLRR

SEQ ID NO: 37847 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKCGVSNKDIEKETAKDAGSEPPSMTQLLRR

SEQ ID NO: 37848 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKCGVSNKDIEKETAKDAGAEPPSMTQLLRR

SEQ ID NO: 37849 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKCGVSNKDIEKETAKDASGEPPSMTQLLRR

SEQ ID NO: 37850 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKCGVSNKDIEKETAKDASSEPPSMTQLLRR

SEQ ID NO: 37851 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKCGVSNKDIEKETAKDASAEPPSMTQLLRR

SEQ ID NO: 37852 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKCGVSNKDIEKETAKDAAGEPPSMTQLLRR

SEQ ID NO: 37853 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKCGVSNKDIEKETAKDAASEPPSMTQLLRR

SEQ ID NO: 37854 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKCGVSNKDIEKETAKDAAAEPPSMTQLLRR

SEQ ID NO: 37855 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKSGVSNKDIEKETAKDGGGEPPSMTQLLRR

SEQ ID NO: 37856 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKSGVSNKDIEKETAKDGGSEPPSMTQLLRR

SEQ ID NO: 37857 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKSGVSNKDIEKETAKDGGAEPPSMTQLLRR

SEQ ID NO: 37858 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKSGVSNKDIEKETAKDGSGEPPSMTQLLRR

SEQ ID NO: 37859 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKSGVSNKDIEKETAKDGSSEPPSMTQLLRR

SEQ ID NO: 37860 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKSGVSNKDIEKETAKDGSAEPPSMTQLLRR

SEQ ID NO: 37861 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKSGVSNKDIEKETAKDGAGEPPSMTQLLRR

SEQ ID NO: 37862 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKSGVSNKDIEKETAKDGASEPPSMTQLLRR

SEQ ID NO: 37863 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKSGVSNKDIEKETAKDGAAEPPSMTQLLRR

SEQ ID NO: 37864 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKSGVSNKDIEKETAKDSGGEPPSMTQLLRR

SEQ ID NO: 37865 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKSGVSNKDIEKETAKDSGSEPPSMTQLLRR

SEQ ID NO: 37866 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKSGVSNKDIEKETAKDSGAEPPSMTQLLRR

SEQ ID NO: 37867 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKSGVSNKDIEKETAKDSSGEPPSMTQLLRR

SEQ ID NO: 37868 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKSGVSNKDIEKETAKDSSSEPPSMTQLLRR

SEQ ID NO: 37869 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKSGVSNKDIEKETAKDSSAEPPSMTQLLRR

SEQ ID NO: 37870 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKSGVSNKDIEKETAKDSAGEPPSMTQLLRR

SEQ ID NO: 37871 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKSGVSNKDIEKETAKDSASEPPSMTQLLRR

SEQ ID NO: 37872 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKSGVSNKDIEKETAKDSAAEPPSMTQLLRR

SEQ ID NO: 37873 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKSGVSNKDIEKETAKDAGGEPPSMTQLLRR

SEQ ID NO: 37874 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKSGVSNKDIEKETAKDAGSEPPSMTQLLRR

SEQ ID NO: 37875 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKSGVSNKDIEKETAKDAGAEPPSMTQLLRR

SEQ ID NO: 37876 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKSGVSNKDIEKETAKDASGEPPSMTQLLRR

SEQ ID NO: 37877 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKSGVSNKDIEKETAKDASSEPPSMTQLLRR

SEQ ID NO: 37878 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKSGVSNKDIEKETAKDASAEPPSMTQLLRR

SEQ ID NO: 37879 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKSGVSNKDIEKETAKDAAGEPPSMTQLLRR

SEQ ID NO: 37880 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKSGVSNKDIEKETAKDAASEPPSMTQLLRR

SEQ ID NO: 37881 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKSGVSNKDIEKETAKDAAAEPPSMTQLLRR

SEQ ID NO: 37882 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKAGVSNKDIEKETAKDGGGEPPSMTQLLRR

SEQ ID NO: 37883 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKAGVSNKDIEKETAKDGGSEPPSMTQLLRR

SEQ ID NO: 37884 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKAGVSNKDIEKETAKDGGAEPPSMTQLLRR

SEQ ID NO: 37885 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKAGVSNKDIEKETAKDGSGEPPSMTQLLRR

SEQ ID NO: 37886 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKAGVSNKDIEKETAKDGSSEPPSMTQLLRR

SEQ ID NO: 37887 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKAGVSNKDIEKETAKDGSAEPPSMTQLLRR

SEQ ID NO: 37888 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKAGVSNKDIEKETAKDGAGEPPSMTQLLRR

SEQ ID NO: 37889 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKAGVSNKDIEKETAKDGASEPPSMTQLLRR

SEQ ID NO: 37890 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKAGVSNKDIEKETAKDGAAEPPSMTQLLRR

SEQ ID NO: 37891 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKAGVSNKDIEKETAKDSGGEPPSMTQLLRR

SEQ ID NO: 37892 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKAGVSNKDIEKETAKDSGSEPPSMTQLLRR

SEQ ID NO: 37893 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKAGVSNKDIEKETAKDSGAEPPSMTQLLRR

SEQ ID NO: 37894 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKAGVSNKDIEKETAKDSSGEPPSMTQLLRR

SEQ ID NO: 37895 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKAGVSNKDIEKETAKDSSSEPPSMTQLLRR

SEQ ID NO: 37896 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKAGVSNKDIEKETAKDSSAEPPSMTQLLRR

SEQ ID NO: 37897 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKAGVSNKDIEKETAKDSAGEPPSMTQLLRR

SEQ ID NO: 37898 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKAGVSNKDIEKETAKDSASEPPSMTQLLRR

SEQ ID NO: 37899 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKAGVSNKDIEKETAKDSAAEPPSMTQLLRR

SEQ ID NO: 37900 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKAGVSNKDIEKETAKDAGGEPPSMTQLLRR

SEQ ID NO: 37901 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKAGVSNKDIEKETAKDAGSEPPSMTQLLRR

SEQ ID NO: 37902 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKAGVSNKDIEKETAKDAGAEPPSMTQLLRR

SEQ ID NO: 37903 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKAGVSNKDIEKETAKDASGEPPSMTQLLRR

SEQ ID NO: 37904 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKAGVSNKDIEKETAKDASSEPPSMTQLLRR

SEQ ID NO: 37905 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKAGVSNKDIEKETAKDASAEPPSMTQLLRR

SEQ ID NO: 37906 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKAGVSNKDIEKETAKDAAGEPPSMTQLLRR

SEQ ID NO: 37907 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKAGVSNKDIEKETAKDAASEPPSMTQLLRR

SEQ ID NO: 37908 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKAGVSNKDIEKETAKDAAAEPPSMTQLLRR

SEQ ID NO: 37909 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKGGVSNKDIEKETAKDGGGEPPSMTQLLRR

SEQ ID NO: 37910 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKGGVSNKDIEKETAKDGGSEPPSMTQLLRR

SEQ ID NO: 37911 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKGGVSNKDIEKETAKDGGAEPPSMTQLLRR

SEQ ID NO: 37912 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKGGVSNKDIEKETAKDGSGEPPSMTQLLRR

SEQ ID NO: 37913 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKGGVSNKDIEKETAKDGSSEPPSMTQLLRR

SEQ ID NO: 37914 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKGGVSNKDIEKETAKDGSAEPPSMTQLLRR

SEQ ID NO: 37915 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKGGVSNKDIEKETAKDGAGEPPSMTQLLRR

SEQ ID NO: 37916 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKGGVSNKDIEKETAKDGASEPPSMTQLLRR

SEQ ID NO: 37917 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKGGVSNKDIEKETAKDGAAEPPSMTQLLRR

SEQ ID NO: 37918 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKGGVSNKDIEKETAKDSGGEPPSMTQLLRR

SEQ ID NO: 37919 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKGGVSNKDIEKETAKDSGSEPPSMTQLLRR

SEQ ID NO: 37920 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKGGVSNKDIEKETAKDSGAEPPSMTQLLRR

SEQ ID NO: 37921 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKGGVSNKDIEKETAKDSSGEPPSMTQLLRR

SEQ ID NO: 37922 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKGGVSNKDIEKETAKDSSSEPPSMTQLLRR

SEQ ID NO: 37923 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKGGVSNKDIEKETAKDSSAEPPSMTQLLRR

SEQ ID NO: 37924 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKGGVSNKDIEKETAKDSAGEPPSMTQLLRR

SEQ ID NO: 37925 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKGGVSNKDIEKETAKDSASEPPSMTQLLRR

SEQ ID NO: 37926 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKGGVSNKDIEKETAKDSAAEPPSMTQLLRR

SEQ ID NO: 37927 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKGGVSNKDIEKETAKDAGGEPPSMTQLLRR

SEQ ID NO: 37928 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKGGVSNKDIEKETAKDAGSEPPSMTQLLRR

SEQ ID NO: 37929 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKGGVSNKDIEKETAKDAGAEPPSMTQLLRR

SEQ ID NO: 37930 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKGGVSNKDIEKETAKDASGEPPSMTQLLRR

SEQ ID NO: 37931 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKGGVSNKDIEKETAKDASSEPPSMTQLLRR

SEQ ID NO: 37932 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKGGVSNKDIEKETAKDASAEPPSMTQLLRR

SEQ ID NO: 37933 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKGGVSNKDIEKETAKDAAGEPPSMTQLLRR

SEQ ID NO: 37934 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKGGVSNKDIEKETAKDAASEPPSMTQLLRR

SEQ ID NO: 37935 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKGGVSNKDIEKETAKDAAAEPPSMTQLLRR

SEQ ID NO: 37936 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKDGVSNKDIEKETAKDGGGEPPSMTQLLRR

SEQ ID NO: 37937 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKDGVSNKDIEKETAKDGGSEPPSMTQLLRR

SEQ ID NO: 37938 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKDGVSNKDIEKETAKDGGAEPPSMTQLLRR

SEQ ID NO: 37939 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKDGVSNKDIEKETAKDGSGEPPSMTQLLRR

SEQ ID NO: 37940 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKDGVSNKDIEKETAKDGSSEPPSMTQLLRR

SEQ ID NO: 37941 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKDGVSNKDIEKETAKDGSAEPPSMTQLLRR

SEQ ID NO: 37942 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKDGVSNKDIEKETAKDGAGEPPSMTQLLRR

SEQ ID NO: 37943 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKDGVSNKDIEKETAKDGASEPPSMTQLLRR

SEQ ID NO: 37944 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKDGVSNKDIEKETAKDGAAEPPSMTQLLRR

SEQ ID NO: 37945 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKDGVSNKDIEKETAKDSGGEPPSMTQLLRR

SEQ ID NO: 37946 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKDGVSNKDIEKETAKDSGSEPPSMTQLLRR

SEQ ID NO: 37947 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKDGVSNKDIEKETAKDSGAEPPSMTQLLRR

SEQ ID NO: 37948 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKDGVSNKDIEKETAKDSSGEPPSMTQLLRR

SEQ ID NO: 37949 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKDGVSNKDIEKETAKDSSSEPPSMTQLLRR

SEQ ID NO: 37950 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKDGVSNKDIEKETAKDSSAEPPSMTQLLRR

SEQ ID NO: 37951 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKDGVSNKDIEKETAKDSAGEPPSMTQLLRR

SEQ ID NO: 37952 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKDGVSNKDIEKETAKDSASEPPSMTQLLRR

SEQ ID NO: 37953 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKDGVSNKDIEKETAKDSAAEPPSMTQLLRR

SEQ ID NO: 37954 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKDGVSNKDIEKETAKDAGGEPPSMTQLLRR

SEQ ID NO: 37955 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKDGVSNKDIEKETAKDAGSEPPSMTQLLRR

SEQ ID NO: 37956 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKDGVSNKDIEKETAKDAGAEPPSMTQLLRR

SEQ ID NO: 37957 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKDGVSNKDIEKETAKDASGEPPSMTQLLRR

SEQ ID NO: 37958 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKDGVSNKDIEKETAKDASSEPPSMTQLLRR

SEQ ID NO: 37959 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKDGVSNKDIEKETAKDASAEPPSMTQLLRR

SEQ ID NO: 37960 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKDGVSNKDIEKETAKDAAGEPPSMTQLLRR

SEQ ID NO: 37961 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKDGVSNKDIEKETAKDAASEPPSMTQLLRR

SEQ ID NO: 37962 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKDGVSNKDIEKETAKDAAAEPPSMTQLLRR

SEQ ID NO: 37963 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKHGVSNKDIEKETAKDGGGEPPSMTQLLRR

SEQ ID NO: 37964 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKHGVSNKDIEKETAKDGGSEPPSMTQLLRR

SEQ ID NO: 37965 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKHGVSNKDIEKETAKDGGAEPPSMTQLLRR

SEQ ID NO: 37966 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKHGVSNKDIEKETAKDGSGEPPSMTQLLRR

SEQ ID NO: 37967 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKHGVSNKDIEKETAKDGSSEPPSMTQLLRR

SEQ ID NO: 37968 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKHGVSNKDIEKETAKDGSAEPPSMTQLLRR

SEQ ID NO: 37969 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKHGVSNKDIEKETAKDGAGEPPSMTQLLRR

SEQ ID NO: 37970 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKHGVSNKDIEKETAKDGASEPPSMTQLLRR

SEQ ID NO: 37971 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKHGVSNKDIEKETAKDGAAEPPSMTQLLRR

SEQ ID NO: 37972 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKHGVSNKDIEKETAKDSGGEPPSMTQLLRR

SEQ ID NO: 37973 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKHGVSNKDIEKETAKDSGSEPPSMTQLLRR

SEQ ID NO: 37974 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKHGVSNKDIEKETAKDSGAEPPSMTQLLRR

SEQ ID NO: 37975 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKHGVSNKDIEKETAKDSSGEPPSMTQLLRR

SEQ ID NO: 37976 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKHGVSNKDIEKETAKDSSSEPPSMTQLLRR

SEQ ID NO: 37977 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKHGVSNKDIEKETAKDSSAEPPSMTQLLRR

SEQ ID NO: 37978 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKHGVSNKDIEKETAKDSAGEPPSMTQLLRR

SEQ ID NO: 37979 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKHGVSNKDIEKETAKDSASEPPSMTQLLRR

SEQ ID NO: 37980 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKHGVSNKDIEKETAKDSAAEPPSMTQLLRR

SEQ ID NO: 37981 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKHGVSNKDIEKETAKDAGGEPPSMTQLLRR

SEQ ID NO: 37982 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKHGVSNKDIEKETAKDAGSEPPSMTQLLRR

SEQ ID NO: 37983 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKHGVSNKDIEKETAKDAGAEPPSMTQLLRR

SEQ ID NO: 37984 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKHGVSNKDIEKETAKDASGEPPSMTQLLRR

SEQ ID NO: 37985 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKHGVSNKDIEKETAKDASSEPPSMTQLLRR

SEQ ID NO: 37986 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKHGVSNKDIEKETAKDASAEPPSMTQLLRR

SEQ ID NO: 37987 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKHGVSNKDIEKETAKDAAGEPPSMTQLLRR

SEQ ID NO: 37988 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKHGVSNKDIEKETAKDAASEPPSMTQLLRR

SEQ ID NO: 37989 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKHGVSNKDIEKETAKDAAAEPPSMTQLLRR

SEQ ID NO: 37990 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKYGVSNKDIEKETAKDGGGEPPSMTQLLRR

SEQ ID NO: 37991 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKYGVSNKDIEKETAKDGGSEPPSMTQLLRR

SEQ ID NO: 37992 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKYGVSNKDIEKETAKDGGAEPPSMTQLLRR

SEQ ID NO: 37993 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKYGVSNKDIEKETAKDGSGEPPSMTQLLRR

SEQ ID NO: 37994 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKYGVSNKDIEKETAKDGSSEPPSMTQLLRR

SEQ ID NO: 37995 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKYGVSNKDIEKETAKDGSAEPPSMTQLLRR

SEQ ID NO: 37996 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKYGVSNKDIEKETAKDGAGEPPSMTQLLRR

SEQ ID NO: 37997 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKYGVSNKDIEKETAKDGASEPPSMTQLLRR

SEQ ID NO: 37998 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKYGVSNKDIEKETAKDGAAEPPSMTQLLRR

SEQ ID NO: 37999 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKYGVSNKDIEKETAKDSGGEPPSMTQLLRR

SEQ ID NO: 38000 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKYGVSNKDIEKETAKDSGSEPPSMTQLLRR

SEQ ID NO: 38001 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKYGVSNKDIEKETAKDSGAEPPSMTQLLRR

SEQ ID NO: 38002 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKYGVSNKDIEKETAKDSSGEPPSMTQLLRR

SEQ ID NO: 38003 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKYGVSNKDIEKETAKDSSSEPPSMTQLLRR

SEQ ID NO: 38004 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKYGVSNKDIEKETAKDSSAEPPSMTQLLRR

SEQ ID NO: 38005 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKYGVSNKDIEKETAKDSAGEPPSMTQLLRR

SEQ ID NO: 38006 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKYGVSNKDIEKETAKDSASEPPSMTQLLRR

SEQ ID NO: 38007 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKYGVSNKDIEKETAKDSAAEPPSMTQLLRR

SEQ ID NO: 38008 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKYGVSNKDIEKETAKDAGGEPPSMTQLLRR

SEQ ID NO: 38009 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKYGVSNKDIEKETAKDAGSEPPSMTQLLRR

SEQ ID NO: 38010 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKYGVSNKDIEKETAKDAGAEPPSMTQLLRR

SEQ ID NO: 38011 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKYGVSNKDIEKETAKDASGEPPSMTQLLRR

SEQ ID NO: 38012 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKYGVSNKDIEKETAKDASSEPPSMTQLLRR

SEQ ID NO: 38013 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKYGVSNKDIEKETAKDASAEPPSMTQLLRR

SEQ ID NO: 38014 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKYGVSNKDIEKETAKDAAGEPPSMTQLLRR

SEQ ID NO: 38015 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKYGVSNKDIEKETAKDAASEPPSMTQLLRR

SEQ ID NO: 38016 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKYGVSNKDIEKETAKDAAAEPPSMTQLLRR

SEQ ID NO: 38017 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKKGVSNKDIEKETAKDGGGEPPSMTQLLRR

SEQ ID NO: 38018 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKKGVSNKDIEKETAKDGGSEPPSMTQLLRR

SEQ ID NO: 38019 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKKGVSNKDIEKETAKDGGAEPPSMTQLLRR

SEQ ID NO: 38020 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKKGVSNKDIEKETAKDGSGEPPSMTQLLRR

SEQ ID NO: 38021 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKKGVSNKDIEKETAKDGSSEPPSMTQLLRR

SEQ ID NO: 38022 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKKGVSNKDIEKETAKDGSAEPPSMTQLLRR

SEQ ID NO: 38023 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKKGVSNKDIEKETAKDGAGEPPSMTQLLRR

SEQ ID NO: 38024 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKKGVSNKDIEKETAKDGASEPPSMTQLLRR

SEQ ID NO: 38025 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKKGVSNKDIEKETAKDGAAEPPSMTQLLRR

SEQ ID NO: 38026 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKKGVSNKDIEKETAKDSGGEPPSMTQLLRR

SEQ ID NO: 38027 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKKGVSNKDIEKETAKDSGSEPPSMTQLLRR

SEQ ID NO: 38028 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKKGVSNKDIEKETAKDSGAEPPSMTQLLRR

SEQ ID NO: 38029 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKKGVSNKDIEKETAKDSSGEPPSMTQLLRR

SEQ ID NO: 38030 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKKGVSNKDIEKETAKDSSSEPPSMTQLLRR

SEQ ID NO: 38031 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKKGVSNKDIEKETAKDSSAEPPSMTQLLRR

SEQ ID NO: 38032 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKKGVSNKDIEKETAKDSAGEPPSMTQLLRR

SEQ ID NO: 38033 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKKGVSNKDIEKETAKDSASEPPSMTQLLRR

SEQ ID NO: 38034 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKKGVSNKDIEKETAKDSAAEPPSMTQLLRR

SEQ ID NO: 38035 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKKGVSNKDIEKETAKDAGGEPPSMTQLLRR

SEQ ID NO: 38036 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKKGVSNKDIEKETAKDAGSEPPSMTQLLRR

SEQ ID NO: 38037 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKKGVSNKDIEKETAKDAGAEPPSMTQLLRR

SEQ ID NO: 38038 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKKGVSNKDIEKETAKDASGEPPSMTQLLRR

SEQ ID NO: 38039 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKKGVSNKDIEKETAKDASSEPPSMTQLLRR

SEQ ID NO: 38040 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKKGVSNKDIEKETAKDASAEPPSMTQLLRR

SEQ ID NO: 38041 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKKGVSNKDIEKETAKDAAGEPPSMTQLLRR

SEQ ID NO: 38042 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKKGVSNKDIEKETAKDAASEPPSMTQLLRR

SEQ ID NO: 38043 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKKGVSNKDIEKETAKDAAAEPPSMTQLLRR

SEQ ID NO: 38044 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKNGVSNKDIEKETAKDGGGEPPSMTQLLRR

SEQ ID NO: 38045 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKNGVSNKDIEKETAKDGGSEPPSMTQLLRR

SEQ ID NO: 38046 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKNGVSNKDIEKETAKDGGAEPPSMTQLLRR

SEQ ID NO: 38047 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKNGVSNKDIEKETAKDGSGEPPSMTQLLRR

SEQ ID NO: 38048 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKNGVSNKDIEKETAKDGSSEPPSMTQLLRR

SEQ ID NO: 38049 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKNGVSNKDIEKETAKDGSAEPPSMTQLLRR

SEQ ID NO: 38050 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKNGVSNKDIEKETAKDGAGEPPSMTQLLRR

SEQ ID NO: 38051 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKNGVSNKDIEKETAKDGASEPPSMTQLLRR

SEQ ID NO: 38052 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKNGVSNKDIEKETAKDGAAEPPSMTQLLRR

SEQ ID NO: 38053 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKNGVSNKDIEKETAKDSGGEPPSMTQLLRR

SEQ ID NO: 38054 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKNGVSNKDIEKETAKDSGSEPPSMTQLLRR

SEQ ID NO: 38055 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKNGVSNKDIEKETAKDSGAEPPSMTQLLRR

SEQ ID NO: 38056 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKNGVSNKDIEKETAKDSSGEPPSMTQLLRR

SEQ ID NO: 38057 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKNGVSNKDIEKETAKDSSSEPPSMTQLLRR

SEQ ID NO: 38058 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKNGVSNKDIEKETAKDSSAEPPSMTQLLRR

SEQ ID NO: 38059 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKNGVSNKDIEKETAKDSAGEPPSMTQLLRR

SEQ ID NO: 38060 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKNGVSNKDIEKETAKDSASEPPSMTQLLRR

SEQ ID NO: 38061 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKNGVSNKDIEKETAKDSAAEPPSMTQLLRR

SEQ ID NO: 38062 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKNGVSNKDIEKETAKDAGGEPPSMTQLLRR

SEQ ID NO: 38063 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKNGVSNKDIEKETAKDAGSEPPSMTQLLRR

SEQ ID NO: 38064 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKNGVSNKDIEKETAKDAGAEPPSMTQLLRR

SEQ ID NO: 38065 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKNGVSNKDIEKETAKDASGEPPSMTQLLRR

SEQ ID NO: 38066 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKNGVSNKDIEKETAKDASSEPPSMTQLLRR

SEQ ID NO: 38067 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKNGVSNKDIEKETAKDASAEPPSMTQLLRR

SEQ ID NO: 38068 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKNGVSNKDIEKETAKDAAGEPPSMTQLLRR

SEQ ID NO: 38069 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKNGVSNKDIEKETAKDAASEPPSMTQLLRR

SEQ ID NO: 38070 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKNGVSNKDIEKETAKDAAAEPPSMTQLLRR

SEQ ID NO: 38071 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKMGVSNKDIEKETAKDGGGEPPSMTQLLRR

SEQ ID NO: 38072 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKMGVSNKDIEKETAKDGGSEPPSMTQLLRR

SEQ ID NO: 38073 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKMGVSNKDIEKETAKDGGAEPPSMTQLLRR

SEQ ID NO: 38074 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKMGVSNKDIEKETAKDGSGEPPSMTQLLRR

SEQ ID NO: 38075 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKMGVSNKDIEKETAKDGSSEPPSMTQLLRR

SEQ ID NO: 38076 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKMGVSNKDIEKETAKDGSAEPPSMTQLLRR

SEQ ID NO: 38077 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKMGVSNKDIEKETAKDGAGEPPSMTQLLRR

SEQ ID NO: 38078 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKMGVSNKDIEKETAKDGASEPPSMTQLLRR

SEQ ID NO: 38079 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKMGVSNKDIEKETAKDGAAEPPSMTQLLRR

SEQ ID NO: 38080 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKMGVSNKDIEKETAKDSGGEPPSMTQLLRR

SEQ ID NO: 38081 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKMGVSNKDIEKETAKDSGSEPPSMTQLLRR

SEQ ID NO: 38082 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKMGVSNKDIEKETAKDSGAEPPSMTQLLRR

SEQ ID NO: 38083 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKMGVSNKDIEKETAKDSSGEPPSMTQLLRR

SEQ ID NO: 38084 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKMGVSNKDIEKETAKDSSSEPPSMTQLLRR

SEQ ID NO: 38085 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKMGVSNKDIEKETAKDSSAEPPSMTQLLRR

SEQ ID NO: 38086 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKMGVSNKDIEKETAKDSAGEPPSMTQLLRR

SEQ ID NO: 38087 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKMGVSNKDIEKETAKDSASEPPSMTQLLRR

SEQ ID NO: 38088 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKMGVSNKDIEKETAKDSAAEPPSMTQLLRR

SEQ ID NO: 38089 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKMGVSNKDIEKETAKDAGGEPPSMTQLLRR

SEQ ID NO: 38090 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKMGVSNKDIEKETAKDAGSEPPSMTQLLRR

SEQ ID NO: 38091 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKMGVSNKDIEKETAKDAGAEPPSMTQLLRR

SEQ ID NO: 38092 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKMGVSNKDIEKETAKDASGEPPSMTQLLRR

SEQ ID NO: 38093 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKMGVSNKDIEKETAKDASSEPPSMTQLLRR

SEQ ID NO: 38094 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKMGVSNKDIEKETAKDASAEPPSMTQLLRR

SEQ ID NO: 38095 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKMGVSNKDIEKETAKDAAGEPPSMTQLLRR

SEQ ID NO: 38096 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKMGVSNKDIEKETAKDAASEPPSMTQLLRR

SEQ ID NO: 38097 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKMGVSNKDIEKETAKDAAAEPPSMTQLLRR

SEQ ID NO: 38098 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKCGVSNKDIEKETAKDGGGEPPSMTQLLRR

SEQ ID NO: 38099 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKCGVSNKDIEKETAKDGGSEPPSMTQLLRR

SEQ ID NO: 38100 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKCGVSNKDIEKETAKDGGAEPPSMTQLLRR

SEQ ID NO: 38101 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKCGVSNKDIEKETAKDGSGEPPSMTQLLRR

SEQ ID NO: 38102 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKCGVSNKDIEKETAKDGSSEPPSMTQLLRR

SEQ ID NO: 38103 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKCGVSNKDIEKETAKDGSAEPPSMTQLLRR

SEQ ID NO: 38104 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKCGVSNKDIEKETAKDGAGEPPSMTQLLRR

SEQ ID NO: 38105 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKCGVSNKDIEKETAKDGASEPPSMTQLLRR

SEQ ID NO: 38106 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKCGVSNKDIEKETAKDGAAEPPSMTQLLRR

SEQ ID NO: 38107 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKCGVSNKDIEKETAKDSGGEPPSMTQLLRR

SEQ ID NO: 38108 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKCGVSNKDIEKETAKDSGSEPPSMTQLLRR

SEQ ID NO: 38109 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKCGVSNKDIEKETAKDSGAEPPSMTQLLRR

SEQ ID NO: 38110 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKCGVSNKDIEKETAKDSSGEPPSMTQLLRR

SEQ ID NO: 38111 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKCGVSNKDIEKETAKDSSSEPPSMTQLLRR

SEQ ID NO: 38112 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKCGVSNKDIEKETAKDSSAEPPSMTQLLRR

SEQ ID NO: 38113 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKCGVSNKDIEKETAKDSAGEPPSMTQLLRR

SEQ ID NO: 38114 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKCGVSNKDIEKETAKDSASEPPSMTQLLRR

SEQ ID NO: 38115 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKCGVSNKDIEKETAKDSAAEPPSMTQLLRR

SEQ ID NO: 38116 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKCGVSNKDIEKETAKDAGGEPPSMTQLLRR

SEQ ID NO: 38117 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKCGVSNKDIEKETAKDAGSEPPSMTQLLRR

SEQ ID NO: 38118 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKCGVSNKDIEKETAKDAGAEPPSMTQLLRR

SEQ ID NO: 38119 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKCGVSNKDIEKETAKDASGEPPSMTQLLRR

SEQ ID NO: 38120 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKCGVSNKDIEKETAKDASSEPPSMTQLLRR

SEQ ID NO: 38121 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKCGVSNKDIEKETAKDASAEPPSMTQLLRR

SEQ ID NO: 38122 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKCGVSNKDIEKETAKDAAGEPPSMTQLLRR

SEQ ID NO: 38123 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKCGVSNKDIEKETAKDAASEPPSMTQLLRR

SEQ ID NO: 38124 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKCGVSNKDIEKETAKDAAAEPPSMTQLLRR

SEQ ID NO: 38125 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKSGVSNKDIEKETAKDGGGEPPSMTQLLRR

SEQ ID NO: 38126 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKSGVSNKDIEKETAKDGGSEPPSMTQLLRR

SEQ ID NO: 38127 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKSGVSNKDIEKETAKDGGAEPPSMTQLLRR

SEQ ID NO: 38128 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKSGVSNKDIEKETAKDGSGEPPSMTQLLRR

SEQ ID NO: 38129 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKSGVSNKDIEKETAKDGSSEPPSMTQLLRR

SEQ ID NO: 38130 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKSGVSNKDIEKETAKDGSAEPPSMTQLLRR

SEQ ID NO: 38131 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKSGVSNKDIEKETAKDGAGEPPSMTQLLRR

SEQ ID NO: 38132 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKSGVSNKDIEKETAKDGASEPPSMTQLLRR

SEQ ID NO: 38133 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKSGVSNKDIEKETAKDGAAEPPSMTQLLRR

SEQ ID NO: 38134 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKSGVSNKDIEKETAKDSGGEPPSMTQLLRR

SEQ ID NO: 38135 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKSGVSNKDIEKETAKDSGSEPPSMTQLLRR

SEQ ID NO: 38136 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKSGVSNKDIEKETAKDSGAEPPSMTQLLRR

SEQ ID NO: 38137 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKSGVSNKDIEKETAKDSSGEPPSMTQLLRR

SEQ ID NO: 38138 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKSGVSNKDIEKETAKDSSSEPPSMTQLLRR

SEQ ID NO: 38139 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKSGVSNKDIEKETAKDSSAEPPSMTQLLRR

SEQ ID NO: 38140 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKSGVSNKDIEKETAKDSAGEPPSMTQLLRR

SEQ ID NO: 38141 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKSGVSNKDIEKETAKDSASEPPSMTQLLRR

SEQ ID NO: 38142 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKSGVSNKDIEKETAKDSAAEPPSMTQLLRR

SEQ ID NO: 38143 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKSGVSNKDIEKETAKDAGGEPPSMTQLLRR

SEQ ID NO: 38144 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKSGVSNKDIEKETAKDAGSEPPSMTQLLRR

SEQ ID NO: 38145 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKSGVSNKDIEKETAKDAGAEPPSMTQLLRR

SEQ ID NO: 38146 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKSGVSNKDIEKETAKDASGEPPSMTQLLRR

SEQ ID NO: 38147 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKSGVSNKDIEKETAKDASSEPPSMTQLLRR

SEQ ID NO: 38148 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKSGVSNKDIEKETAKDASAEPPSMTQLLRR

SEQ ID NO: 38149 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKSGVSNKDIEKETAKDAAGEPPSMTQLLRR

SEQ ID NO: 38150 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKSGVSNKDIEKETAKDAASEPPSMTQLLRR

SEQ ID NO: 38151 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKSGVSNKDIEKETAKDAAAEPPSMTQLLRR

SEQ ID NO: 38152 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKAGVSNKDIEKETAKDGGGEPPSMTQLLRR

SEQ ID NO: 38153 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKAGVSNKDIEKETAKDGGSEPPSMTQLLRR

SEQ ID NO: 38154 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKAGVSNKDIEKETAKDGGAEPPSMTQLLRR

SEQ ID NO: 38155 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKAGVSNKDIEKETAKDGSGEPPSMTQLLRR

SEQ ID NO: 38156 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKAGVSNKDIEKETAKDGSSEPPSMTQLLRR

SEQ ID NO: 38157 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKAGVSNKDIEKETAKDGSAEPPSMTQLLRR

SEQ ID NO: 38158 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKAGVSNKDIEKETAKDGAGEPPSMTQLLRR

SEQ ID NO: 38159 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKAGVSNKDIEKETAKDGASEPPSMTQLLRR

SEQ ID NO: 38160 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKAGVSNKDIEKETAKDGAAEPPSMTQLLRR

SEQ ID NO: 38161 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKAGVSNKDIEKETAKDSGGEPPSMTQLLRR

SEQ ID NO: 38162 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKAGVSNKDIEKETAKDSGSEPPSMTQLLRR

SEQ ID NO: 38163 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKAGVSNKDIEKETAKDSGAEPPSMTQLLRR

SEQ ID NO: 38164 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKAGVSNKDIEKETAKDSSGEPPSMTQLLRR

SEQ ID NO: 38165 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKAGVSNKDIEKETAKDSSSEPPSMTQLLRR

SEQ ID NO: 38166 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKAGVSNKDIEKETAKDSSAEPPSMTQLLRR

SEQ ID NO: 38167 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKAGVSNKDIEKETAKDSAGEPPSMTQLLRR

SEQ ID NO: 38168 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKAGVSNKDIEKETAKDSASEPPSMTQLLRR

SEQ ID NO: 38169 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKAGVSNKDIEKETAKDSAAEPPSMTQLLRR

SEQ ID NO: 38170 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKAGVSNKDIEKETAKDAGGEPPSMTQLLRR

SEQ ID NO: 38171 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKAGVSNKDIEKETAKDAGSEPPSMTQLLRR

SEQ ID NO: 38172 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKAGVSNKDIEKETAKDAGAEPPSMTQLLRR

SEQ ID NO: 38173 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKAGVSNKDIEKETAKDASGEPPSMTQLLRR

SEQ ID NO: 38174 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKAGVSNKDIEKETAKDASSEPPSMTQLLRR

SEQ ID NO: 38175 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKAGVSNKDIEKETAKDASAEPPSMTQLLRR

SEQ ID NO: 38176 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKAGVSNKDIEKETAKDAAGEPPSMTQLLRR

SEQ ID NO: 38177 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKAGVSNKDIEKETAKDAASEPPSMTQLLRR

SEQ ID NO: 38178 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKAGVSNKDIEKETAKDAAAEPPSMTQLLRR

SEQ ID NO: 38179 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKGGVSNKDIEKETAKDGGGEPPSMTQLLRR

SEQ ID NO: 38180 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKGGVSNKDIEKETAKDGGSEPPSMTQLLRR

SEQ ID NO: 38181 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKGGVSNKDIEKETAKDGGAEPPSMTQLLRR

SEQ ID NO: 38182 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKGGVSNKDIEKETAKDGSGEPPSMTQLLRR

SEQ ID NO: 38183 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKGGVSNKDIEKETAKDGSSEPPSMTQLLRR

SEQ ID NO: 38184 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKGGVSNKDIEKETAKDGSAEPPSMTQLLRR

SEQ ID NO: 38185 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKGGVSNKDIEKETAKDGAGEPPSMTQLLRR

SEQ ID NO: 38186 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKGGVSNKDIEKETAKDGASEPPSMTQLLRR

SEQ ID NO: 38187 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKGGVSNKDIEKETAKDGAAEPPSMTQLLRR

SEQ ID NO: 38188 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKGGVSNKDIEKETAKDSGGEPPSMTQLLRR

SEQ ID NO: 38189 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKGGVSNKDIEKETAKDSGSEPPSMTQLLRR

SEQ ID NO: 38190 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKGGVSNKDIEKETAKDSGAEPPSMTQLLRR

SEQ ID NO: 38191 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKGGVSNKDIEKETAKDSSGEPPSMTQLLRR

SEQ ID NO: 38192 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKGGVSNKDIEKETAKDSSSEPPSMTQLLRR

SEQ ID NO: 38193 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKGGVSNKDIEKETAKDSSAEPPSMTQLLRR

SEQ ID NO: 38194 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKGGVSNKDIEKETAKDSAGEPPSMTQLLRR

SEQ ID NO: 38195 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKGGVSNKDIEKETAKDSASEPPSMTQLLRR

SEQ ID NO: 38196 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKGGVSNKDIEKETAKDSAAEPPSMTQLLRR

SEQ ID NO: 38197 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKGGVSNKDIEKETAKDAGGEPPSMTQLLRR

SEQ ID NO: 38198 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKGGVSNKDIEKETAKDAGSEPPSMTQLLRR

SEQ ID NO: 38199 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKGGVSNKDIEKETAKDAGAEPPSMTQLLRR

SEQ ID NO: 38200 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKGGVSNKDIEKETAKDASGEPPSMTQLLRR

SEQ ID NO: 38201 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKGGVSNKDIEKETAKDASSEPPSMTQLLRR

SEQ ID NO: 38202 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKGGVSNKDIEKETAKDASAEPPSMTQLLRR

SEQ ID NO: 38203 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKGGVSNKDIEKETAKDAAGEPPSMTQLLRR

SEQ ID NO: 38204 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKGGVSNKDIEKETAKDAASEPPSMTQLLRR

SEQ ID NO: 38205 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKGGVSNKDIEKETAKDAAAEPPSMTQLLRR

SEQ ID NO: 38206 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKDGVSNKDIEKETAKDGGGEPPSMTQLLRR

SEQ ID NO: 38207 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKDGVSNKDIEKETAKDGGSEPPSMTQLLRR

SEQ ID NO: 38208 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKDGVSNKDIEKETAKDGGAEPPSMTQLLRR

SEQ ID NO: 38209 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKDGVSNKDIEKETAKDGSGEPPSMTQLLRR

SEQ ID NO: 38210 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKDGVSNKDIEKETAKDGSSEPPSMTQLLRR

SEQ ID NO: 38211 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKDGVSNKDIEKETAKDGSAEPPSMTQLLRR

SEQ ID NO: 38212 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKDGVSNKDIEKETAKDGAGEPPSMTQLLRR

SEQ ID NO: 38213 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKDGVSNKDIEKETAKDGASEPPSMTQLLRR

SEQ ID NO: 38214 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKDGVSNKDIEKETAKDGAAEPPSMTQLLRR

SEQ ID NO: 38215 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKDGVSNKDIEKETAKDSGGEPPSMTQLLRR

SEQ ID NO: 38216 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKDGVSNKDIEKETAKDSGSEPPSMTQLLRR

SEQ ID NO: 38217 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKDGVSNKDIEKETAKDSGAEPPSMTQLLRR

SEQ ID NO: 38218 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKDGVSNKDIEKETAKDSSGEPPSMTQLLRR

SEQ ID NO: 38219 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKDGVSNKDIEKETAKDSSSEPPSMTQLLRR

SEQ ID NO: 38220 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKDGVSNKDIEKETAKDSSAEPPSMTQLLRR

SEQ ID NO: 38221 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKDGVSNKDIEKETAKDSAGEPPSMTQLLRR

SEQ ID NO: 38222 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKDGVSNKDIEKETAKDSASEPPSMTQLLRR

SEQ ID NO: 38223 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKDGVSNKDIEKETAKDSAAEPPSMTQLLRR

SEQ ID NO: 38224 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKDGVSNKDIEKETAKDAGGEPPSMTQLLRR

SEQ ID NO: 38225 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKDGVSNKDIEKETAKDAGSEPPSMTQLLRR

SEQ ID NO: 38226 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKDGVSNKDIEKETAKDAGAEPPSMTQLLRR

SEQ ID NO: 38227 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKDGVSNKDIEKETAKDASGEPPSMTQLLRR

SEQ ID NO: 38228 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKDGVSNKDIEKETAKDASSEPPSMTQLLRR

SEQ ID NO: 38229 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKDGVSNKDIEKETAKDASAEPPSMTQLLRR

SEQ ID NO: 38230 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKDGVSNKDIEKETAKDAAGEPPSMTQLLRR

SEQ ID NO: 38231 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKDGVSNKDIEKETAKDAASEPPSMTQLLRR

SEQ ID NO: 38232 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKDGVSNKDIEKETAKDAAAEPPSMTQLLRR

SEQ ID NO: 38233 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKHGVSNKDIEKETAKDGGGEPPSMTQLLRR

SEQ ID NO: 38234 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKHGVSNKDIEKETAKDGGSEPPSMTQLLRR

SEQ ID NO: 38235 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKHGVSNKDIEKETAKDGGAEPPSMTQLLRR

SEQ ID NO: 38236 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKHGVSNKDIEKETAKDGSGEPPSMTQLLRR

SEQ ID NO: 38237 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKHGVSNKDIEKETAKDGSSEPPSMTQLLRR

SEQ ID NO: 38238 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKHGVSNKDIEKETAKDGSAEPPSMTQLLRR

SEQ ID NO: 38239 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKHGVSNKDIEKETAKDGAGEPPSMTQLLRR

SEQ ID NO: 38240 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKHGVSNKDIEKETAKDGASEPPSMTQLLRR

SEQ ID NO: 38241 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKHGVSNKDIEKETAKDGAAEPPSMTQLLRR

SEQ ID NO: 38242 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKHGVSNKDIEKETAKDSGGEPPSMTQLLRR

SEQ ID NO: 38243 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKHGVSNKDIEKETAKDSGSEPPSMTQLLRR

SEQ ID NO: 38244 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKHGVSNKDIEKETAKDSGAEPPSMTQLLRR

SEQ ID NO: 38245 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKHGVSNKDIEKETAKDSSGEPPSMTQLLRR

SEQ ID NO: 38246 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKHGVSNKDIEKETAKDSSSEPPSMTQLLRR

SEQ ID NO: 38247 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKHGVSNKDIEKETAKDSSAEPPSMTQLLRR

SEQ ID NO: 38248 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKHGVSNKDIEKETAKDSAGEPPSMTQLLRR

SEQ ID NO: 38249 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKHGVSNKDIEKETAKDSASEPPSMTQLLRR

SEQ ID NO: 38250 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKHGVSNKDIEKETAKDSAAEPPSMTQLLRR

SEQ ID NO: 38251 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKHGVSNKDIEKETAKDAGGEPPSMTQLLRR

SEQ ID NO: 38252 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKHGVSNKDIEKETAKDAGSEPPSMTQLLRR

SEQ ID NO: 38253 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKHGVSNKDIEKETAKDAGAEPPSMTQLLRR

SEQ ID NO: 38254 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKHGVSNKDIEKETAKDASGEPPSMTQLLRR

SEQ ID NO: 38255 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKHGVSNKDIEKETAKDASSEPPSMTQLLRR

SEQ ID NO: 38256 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKHGVSNKDIEKETAKDASAEPPSMTQLLRR

SEQ ID NO: 38257 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKHGVSNKDIEKETAKDAAGEPPSMTQLLRR

SEQ ID NO: 38258 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKHGVSNKDIEKETAKDAASEPPSMTQLLRR

SEQ ID NO: 38259 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKHGVSNKDIEKETAKDAAAEPPSMTQLLRR

SEQ ID NO: 38260 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKYGVSNKDIEKETAKDGGGEPPSMTQLLRR

SEQ ID NO: 38261 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKYGVSNKDIEKETAKDGGSEPPSMTQLLRR

SEQ ID NO: 38262 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKYGVSNKDIEKETAKDGGAEPPSMTQLLRR

SEQ ID NO: 38263 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKYGVSNKDIEKETAKDGSGEPPSMTQLLRR

SEQ ID NO: 38264 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKYGVSNKDIEKETAKDGSSEPPSMTQLLRR

SEQ ID NO: 38265 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKYGVSNKDIEKETAKDGSAEPPSMTQLLRR

SEQ ID NO: 38266 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKYGVSNKDIEKETAKDGAGEPPSMTQLLRR

SEQ ID NO: 38267 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKYGVSNKDIEKETAKDGASEPPSMTQLLRR

SEQ ID NO: 38268 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKYGVSNKDIEKETAKDGAAEPPSMTQLLRR

SEQ ID NO: 38269 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKYGVSNKDIEKETAKDSGGEPPSMTQLLRR

SEQ ID NO: 38270 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKYGVSNKDIEKETAKDSGSEPPSMTQLLRR

SEQ ID NO: 38271 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKYGVSNKDIEKETAKDSGAEPPSMTQLLRR

SEQ ID NO: 38272 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKYGVSNKDIEKETAKDSSGEPPSMTQLLRR

SEQ ID NO: 38273 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKYGVSNKDIEKETAKDSSSEPPSMTQLLRR

SEQ ID NO: 38274 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKYGVSNKDIEKETAKDSSAEPPSMTQLLRR

SEQ ID NO: 38275 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKYGVSNKDIEKETAKDSAGEPPSMTQLLRR

SEQ ID NO: 38276 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKYGVSNKDIEKETAKDSASEPPSMTQLLRR

SEQ ID NO: 38277 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKYGVSNKDIEKETAKDSAAEPPSMTQLLRR

SEQ ID NO: 38278 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKYGVSNKDIEKETAKDAGGEPPSMTQLLRR

SEQ ID NO: 38279 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKYGVSNKDIEKETAKDAGSEPPSMTQLLRR

SEQ ID NO: 38280 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKYGVSNKDIEKETAKDAGAEPPSMTQLLRR

SEQ ID NO: 38281 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKYGVSNKDIEKETAKDASGEPPSMTQLLRR

SEQ ID NO: 38282 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKYGVSNKDIEKETAKDASSEPPSMTQLLRR

SEQ ID NO: 38283 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKYGVSNKDIEKETAKDASAEPPSMTQLLRR

SEQ ID NO: 38284 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKYGVSNKDIEKETAKDAAGEPPSMTQLLRR

SEQ ID NO: 38285 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKYGVSNKDIEKETAKDAASEPPSMTQLLRR

SEQ ID NO: 38286 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKYGVSNKDIEKETAKDAAAEPPSMTQLLRR

SEQ ID NO: 38287 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKKGVSNKDIEKETAKDGGGEPPSMTQLLRR

SEQ ID NO: 38288 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKKGVSNKDIEKETAKDGGSEPPSMTQLLRR

SEQ ID NO: 38289 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKKGVSNKDIEKETAKDGGAEPPSMTQLLRR

SEQ ID NO: 38290 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKKGVSNKDIEKETAKDGSGEPPSMTQLLRR

SEQ ID NO: 38291 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKKGVSNKDIEKETAKDGSSEPPSMTQLLRR

SEQ ID NO: 38292 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKKGVSNKDIEKETAKDGSAEPPSMTQLLRR

SEQ ID NO: 38293 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKKGVSNKDIEKETAKDGAGEPPSMTQLLRR

SEQ ID NO: 38294 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKKGVSNKDIEKETAKDGASEPPSMTQLLRR

SEQ ID NO: 38295 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKKGVSNKDIEKETAKDGAAEPPSMTQLLRR

SEQ ID NO: 38296 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKKGVSNKDIEKETAKDSGGEPPSMTQLLRR

SEQ ID NO: 38297 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKKGVSNKDIEKETAKDSGSEPPSMTQLLRR

SEQ ID NO: 38298 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKKGVSNKDIEKETAKDSGAEPPSMTQLLRR

SEQ ID NO: 38299 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKKGVSNKDIEKETAKDSSGEPPSMTQLLRR

SEQ ID NO: 38300 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKKGVSNKDIEKETAKDSSSEPPSMTQLLRR

SEQ ID NO: 38301 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKKGVSNKDIEKETAKDSSAEPPSMTQLLRR

SEQ ID NO: 38302 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKKGVSNKDIEKETAKDSAGEPPSMTQLLRR

SEQ ID NO: 38303 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKKGVSNKDIEKETAKDSASEPPSMTQLLRR

SEQ ID NO: 38304 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKKGVSNKDIEKETAKDSAAEPPSMTQLLRR

SEQ ID NO: 38305 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKKGVSNKDIEKETAKDAGGEPPSMTQLLRR

SEQ ID NO: 38306 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKKGVSNKDIEKETAKDAGSEPPSMTQLLRR

SEQ ID NO: 38307 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKKGVSNKDIEKETAKDAGAEPPSMTQLLRR

SEQ ID NO: 38308 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKKGVSNKDIEKETAKDASGEPPSMTQLLRR

SEQ ID NO: 38309 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKKGVSNKDIEKETAKDASSEPPSMTQLLRR

SEQ ID NO: 38310 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKKGVSNKDIEKETAKDASAEPPSMTQLLRR

SEQ ID NO: 38311 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKKGVSNKDIEKETAKDAAGEPPSMTQLLRR

SEQ ID NO: 38312 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKKGVSNKDIEKETAKDAASEPPSMTQLLRR

SEQ ID NO: 38313 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKKGVSNKDIEKETAKDAAAEPPSMTQLLRR

SEQ ID NO: 38314 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKNGVSNKDIEKETAKDGGGEPPSMTQLLRR

SEQ ID NO: 38315 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKNGVSNKDIEKETAKDGGSEPPSMTQLLRR

SEQ ID NO: 38316 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKNGVSNKDIEKETAKDGGAEPPSMTQLLRR

SEQ ID NO: 38317 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKNGVSNKDIEKETAKDGSGEPPSMTQLLRR

SEQ ID NO: 38318 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKNGVSNKDIEKETAKDGSSEPPSMTQLLRR

SEQ ID NO: 38319 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKNGVSNKDIEKETAKDGSAEPPSMTQLLRR

SEQ ID NO: 38320 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKNGVSNKDIEKETAKDGAGEPPSMTQLLRR

SEQ ID NO: 38321 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKNGVSNKDIEKETAKDGASEPPSMTQLLRR

SEQ ID NO: 38322 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKNGVSNKDIEKETAKDGAAEPPSMTQLLRR

SEQ ID NO: 38323 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKNGVSNKDIEKETAKDSGGEPPSMTQLLRR

SEQ ID NO: 38324 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKNGVSNKDIEKETAKDSGSEPPSMTQLLRR

SEQ ID NO: 38325 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKNGVSNKDIEKETAKDSGAEPPSMTQLLRR

SEQ ID NO: 38326 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKNGVSNKDIEKETAKDSSGEPPSMTQLLRR

SEQ ID NO: 38327 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKNGVSNKDIEKETAKDSSSEPPSMTQLLRR

SEQ ID NO: 38328 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKNGVSNKDIEKETAKDSSAEPPSMTQLLRR

SEQ ID NO: 38329 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKNGVSNKDIEKETAKDSAGEPPSMTQLLRR

SEQ ID NO: 38330 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKNGVSNKDIEKETAKDSASEPPSMTQLLRR

SEQ ID NO: 38331 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKNGVSNKDIEKETAKDSAAEPPSMTQLLRR

SEQ ID NO: 38332 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKNGVSNKDIEKETAKDAGGEPPSMTQLLRR

SEQ ID NO: 38333 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKNGVSNKDIEKETAKDAGSEPPSMTQLLRR

SEQ ID NO: 38334 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKNGVSNKDIEKETAKDAGAEPPSMTQLLRR

SEQ ID NO: 38335 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKNGVSNKDIEKETAKDASGEPPSMTQLLRR

SEQ ID NO: 38336 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKNGVSNKDIEKETAKDASSEPPSMTQLLRR

SEQ ID NO: 38337 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKNGVSNKDIEKETAKDASAEPPSMTQLLRR

SEQ ID NO: 38338 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKNGVSNKDIEKETAKDAAGEPPSMTQLLRR

SEQ ID NO: 38339 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKNGVSNKDIEKETAKDAASEPPSMTQLLRR

SEQ ID NO: 38340 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKNGVSNKDIEKETAKDAAAEPPSMTQLLRR

SEQ ID NO: 38341 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKMGVSNKDIEKETAKDGGGEPPSMTQLLRR

SEQ ID NO: 38342 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKMGVSNKDIEKETAKDGGSEPPSMTQLLRR

SEQ ID NO: 38343 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKMGVSNKDIEKETAKDGGAEPPSMTQLLRR

SEQ ID NO: 38344 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKMGVSNKDIEKETAKDGSGEPPSMTQLLRR

SEQ ID NO: 38345 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKMGVSNKDIEKETAKDGSSEPPSMTQLLRR

SEQ ID NO: 38346 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKMGVSNKDIEKETAKDGSAEPPSMTQLLRR

SEQ ID NO: 38347 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKMGVSNKDIEKETAKDGAGEPPSMTQLLRR

SEQ ID NO: 38348 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKMGVSNKDIEKETAKDGASEPPSMTQLLRR

SEQ ID NO: 38349 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKMGVSNKDIEKETAKDGAAEPPSMTQLLRR

SEQ ID NO: 38350 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKMGVSNKDIEKETAKDSGGEPPSMTQLLRR

SEQ ID NO: 38351 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKMGVSNKDIEKETAKDSGSEPPSMTQLLRR

SEQ ID NO: 38352 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKMGVSNKDIEKETAKDSGAEPPSMTQLLRR

SEQ ID NO: 38353 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKMGVSNKDIEKETAKDSSGEPPSMTQLLRR

SEQ ID NO: 38354 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKMGVSNKDIEKETAKDSSSEPPSMTQLLRR

SEQ ID NO: 38355 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKMGVSNKDIEKETAKDSSAEPPSMTQLLRR

SEQ ID NO: 38356 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKMGVSNKDIEKETAKDSAGEPPSMTQLLRR

SEQ ID NO: 38357 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKMGVSNKDIEKETAKDSASEPPSMTQLLRR

SEQ ID NO: 38358 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKMGVSNKDIEKETAKDSAAEPPSMTQLLRR

SEQ ID NO: 38359 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKMGVSNKDIEKETAKDAGGEPPSMTQLLRR

SEQ ID NO: 38360 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKMGVSNKDIEKETAKDAGSEPPSMTQLLRR

SEQ ID NO: 38361 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKMGVSNKDIEKETAKDAGAEPPSMTQLLRR

SEQ ID NO: 38362 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKMGVSNKDIEKETAKDASGEPPSMTQLLRR

SEQ ID NO: 38363 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKMGVSNKDIEKETAKDASSEPPSMTQLLRR

SEQ ID NO: 38364 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKMGVSNKDIEKETAKDASAEPPSMTQLLRR

SEQ ID NO: 38365 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKMGVSNKDIEKETAKDAAGEPPSMTQLLRR

SEQ ID NO: 38366 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKMGVSNKDIEKETAKDAASEPPSMTQLLRR

SEQ ID NO: 38367 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKMGVSNKDIEKETAKDAAAEPPSMTQLLRR

SEQ ID NO: 38368 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKCGVSNKDIEKETAKDGGGEPPSMTQLLRR

SEQ ID NO: 38369 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKCGVSNKDIEKETAKDGGSEPPSMTQLLRR

SEQ ID NO: 38370 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKCGVSNKDIEKETAKDGGAEPPSMTQLLRR

SEQ ID NO: 38371 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKCGVSNKDIEKETAKDGSGEPPSMTQLLRR

SEQ ID NO: 38372 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKCGVSNKDIEKETAKDGSSEPPSMTQLLRR

SEQ ID NO: 38373 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKCGVSNKDIEKETAKDGSAEPPSMTQLLRR

SEQ ID NO: 38374 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKCGVSNKDIEKETAKDGAGEPPSMTQLLRR

SEQ ID NO: 38375 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKCGVSNKDIEKETAKDGASEPPSMTQLLRR

SEQ ID NO: 38376 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKCGVSNKDIEKETAKDGAAEPPSMTQLLRR

SEQ ID NO: 38377 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKCGVSNKDIEKETAKDSGGEPPSMTQLLRR

SEQ ID NO: 38378 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKCGVSNKDIEKETAKDSGSEPPSMTQLLRR

SEQ ID NO: 38379 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKCGVSNKDIEKETAKDSGAEPPSMTQLLRR

SEQ ID NO: 38380 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKCGVSNKDIEKETAKDSSGEPPSMTQLLRR

SEQ ID NO: 38381 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKCGVSNKDIEKETAKDSSSEPPSMTQLLRR

SEQ ID NO: 38382 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKCGVSNKDIEKETAKDSSAEPPSMTQLLRR

SEQ ID NO: 38383 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKCGVSNKDIEKETAKDSAGEPPSMTQLLRR

SEQ ID NO: 38384 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKCGVSNKDIEKETAKDSASEPPSMTQLLRR

SEQ ID NO: 38385 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKCGVSNKDIEKETAKDSAAEPPSMTQLLRR

SEQ ID NO: 38386 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKCGVSNKDIEKETAKDAGGEPPSMTQLLRR

SEQ ID NO: 38387 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKCGVSNKDIEKETAKDAGSEPPSMTQLLRR

SEQ ID NO: 38388 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKCGVSNKDIEKETAKDAGAEPPSMTQLLRR

SEQ ID NO: 38389 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKCGVSNKDIEKETAKDASGEPPSMTQLLRR

SEQ ID NO: 38390 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKCGVSNKDIEKETAKDASSEPPSMTQLLRR

SEQ ID NO: 38391 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKCGVSNKDIEKETAKDASAEPPSMTQLLRR

SEQ ID NO: 38392 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKCGVSNKDIEKETAKDAAGEPPSMTQLLRR

SEQ ID NO: 38393 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKCGVSNKDIEKETAKDAASEPPSMTQLLRR

SEQ ID NO: 38394 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKCGVSNKDIEKETAKDAAAEPPSMTQLLRR

SEQ ID NO: 38395 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKSGVSNKDIEKETAKDGGGEPPSMTQLLRR

SEQ ID NO: 38396 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKSGVSNKDIEKETAKDGGSEPPSMTQLLRR

SEQ ID NO: 38397 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKSGVSNKDIEKETAKDGGAEPPSMTQLLRR

SEQ ID NO: 38398 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKSGVSNKDIEKETAKDGSGEPPSMTQLLRR

SEQ ID NO: 38399 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKSGVSNKDIEKETAKDGSSEPPSMTQLLRR

SEQ ID NO: 38400 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKSGVSNKDIEKETAKDGSAEPPSMTQLLRR

SEQ ID NO: 38401 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKSGVSNKDIEKETAKDGAGEPPSMTQLLRR

SEQ ID NO: 38402 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKSGVSNKDIEKETAKDGASEPPSMTQLLRR

SEQ ID NO: 38403 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKSGVSNKDIEKETAKDGAAEPPSMTQLLRR

SEQ ID NO: 38404 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKSGVSNKDIEKETAKDSGGEPPSMTQLLRR

SEQ ID NO: 38405 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKSGVSNKDIEKETAKDSGSEPPSMTQLLRR

SEQ ID NO: 38406 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKSGVSNKDIEKETAKDSGAEPPSMTQLLRR

SEQ ID NO: 38407 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKSGVSNKDIEKETAKDSSGEPPSMTQLLRR

SEQ ID NO: 38408 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKSGVSNKDIEKETAKDSSSEPPSMTQLLRR

SEQ ID NO: 38409 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKSGVSNKDIEKETAKDSSAEPPSMTQLLRR

SEQ ID NO: 38410 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKSGVSNKDIEKETAKDSAGEPPSMTQLLRR

SEQ ID NO: 38411 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKSGVSNKDIEKETAKDSASEPPSMTQLLRR

SEQ ID NO: 38412 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKSGVSNKDIEKETAKDSAAEPPSMTQLLRR

SEQ ID NO: 38413 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKSGVSNKDIEKETAKDAGGEPPSMTQLLRR

SEQ ID NO: 38414 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKSGVSNKDIEKETAKDAGSEPPSMTQLLRR

SEQ ID NO: 38415 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKSGVSNKDIEKETAKDAGAEPPSMTQLLRR

SEQ ID NO: 38416 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKSGVSNKDIEKETAKDASGEPPSMTQLLRR

SEQ ID NO: 38417 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKSGVSNKDIEKETAKDASSEPPSMTQLLRR

SEQ ID NO: 38418 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKSGVSNKDIEKETAKDASAEPPSMTQLLRR

SEQ ID NO: 38419 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKSGVSNKDIEKETAKDAAGEPPSMTQLLRR

SEQ ID NO: 38420 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKSGVSNKDIEKETAKDAASEPPSMTQLLRR

SEQ ID NO: 38421 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKSGVSNKDIEKETAKDAAAEPPSMTQLLRR

SEQ ID NO: 38422 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKAGVSNKDIEKETAKDGGGEPPSMTQLLRR

SEQ ID NO: 38423 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKAGVSNKDIEKETAKDGGSEPPSMTQLLRR

SEQ ID NO: 38424 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKAGVSNKDIEKETAKDGGAEPPSMTQLLRR

SEQ ID NO: 38425 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKAGVSNKDIEKETAKDGSGEPPSMTQLLRR

SEQ ID NO: 38426 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKAGVSNKDIEKETAKDGSSEPPSMTQLLRR

SEQ ID NO: 38427 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKAGVSNKDIEKETAKDGSAEPPSMTQLLRR

SEQ ID NO: 38428 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKAGVSNKDIEKETAKDGAGEPPSMTQLLRR

SEQ ID NO: 38429 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKAGVSNKDIEKETAKDGASEPPSMTQLLRR

SEQ ID NO: 38430 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKAGVSNKDIEKETAKDGAAEPPSMTQLLRR

SEQ ID NO: 38431 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKAGVSNKDIEKETAKDSGGEPPSMTQLLRR

SEQ ID NO: 38432 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKAGVSNKDIEKETAKDSGSEPPSMTQLLRR

SEQ ID NO: 38433 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKAGVSNKDIEKETAKDSGAEPPSMTQLLRR

SEQ ID NO: 38434 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKAGVSNKDIEKETAKDSSGEPPSMTQLLRR

SEQ ID NO: 38435 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKAGVSNKDIEKETAKDSSSEPPSMTQLLRR

SEQ ID NO: 38436 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKAGVSNKDIEKETAKDSSAEPPSMTQLLRR

SEQ ID NO: 38437 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKAGVSNKDIEKETAKDSAGEPPSMTQLLRR

SEQ ID NO: 38438 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKAGVSNKDIEKETAKDSASEPPSMTQLLRR

SEQ ID NO: 38439 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKAGVSNKDIEKETAKDSAAEPPSMTQLLRR

SEQ ID NO: 38440 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKAGVSNKDIEKETAKDAGGEPPSMTQLLRR

SEQ ID NO: 38441 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKAGVSNKDIEKETAKDAGSEPPSMTQLLRR

SEQ ID NO: 38442 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKAGVSNKDIEKETAKDAGAEPPSMTQLLRR

SEQ ID NO: 38443 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKAGVSNKDIEKETAKDASGEPPSMTQLLRR

SEQ ID NO: 38444 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKAGVSNKDIEKETAKDASSEPPSMTQLLRR

SEQ ID NO: 38445 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKAGVSNKDIEKETAKDASAEPPSMTQLLRR

SEQ ID NO: 38446 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKAGVSNKDIEKETAKDAAGEPPSMTQLLRR

SEQ ID NO: 38447 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKAGVSNKDIEKETAKDAASEPPSMTQLLRR

SEQ ID NO: 38448 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKAGVSNKDIEKETAKDAAAEPPSMTQLLRR

SEQ ID NO: 38449 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKGGVSNKDIEKETAKDGGGEPPSMTQLLRR

SEQ ID NO: 38450 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKGGVSNKDIEKETAKDGGSEPPSMTQLLRR

SEQ ID NO: 38451 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKGGVSNKDIEKETAKDGGAEPPSMTQLLRR

SEQ ID NO: 38452 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKGGVSNKDIEKETAKDGSGEPPSMTQLLRR

SEQ ID NO: 38453 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKGGVSNKDIEKETAKDGSSEPPSMTQLLRR

SEQ ID NO: 38454 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKGGVSNKDIEKETAKDGSAEPPSMTQLLRR

SEQ ID NO: 38455 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKGGVSNKDIEKETAKDGAGEPPSMTQLLRR

SEQ ID NO: 38456 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKGGVSNKDIEKETAKDGASEPPSMTQLLRR

SEQ ID NO: 38457 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKGGVSNKDIEKETAKDGAAEPPSMTQLLRR

SEQ ID NO: 38458 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKGGVSNKDIEKETAKDSGGEPPSMTQLLRR

SEQ ID NO: 38459 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKGGVSNKDIEKETAKDSGSEPPSMTQLLRR

SEQ ID NO: 38460 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKGGVSNKDIEKETAKDSGAEPPSMTQLLRR

SEQ ID NO: 38461 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKGGVSNKDIEKETAKDSSGEPPSMTQLLRR

SEQ ID NO: 38462 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKGGVSNKDIEKETAKDSSSEPPSMTQLLRR

SEQ ID NO: 38463 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKGGVSNKDIEKETAKDSSAEPPSMTQLLRR

SEQ ID NO: 38464 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKGGVSNKDIEKETAKDSAGEPPSMTQLLRR

SEQ ID NO: 38465 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKGGVSNKDIEKETAKDSASEPPSMTQLLRR

SEQ ID NO: 38466 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKGGVSNKDIEKETAKDSAAEPPSMTQLLRR

SEQ ID NO: 38467 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKGGVSNKDIEKETAKDAGGEPPSMTQLLRR

SEQ ID NO: 38468 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKGGVSNKDIEKETAKDAGSEPPSMTQLLRR

SEQ ID NO: 38469 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKGGVSNKDIEKETAKDAGAEPPSMTQLLRR

SEQ ID NO: 38470 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKGGVSNKDIEKETAKDASGEPPSMTQLLRR

SEQ ID NO: 38471 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKGGVSNKDIEKETAKDASSEPPSMTQLLRR

SEQ ID NO: 38472 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKGGVSNKDIEKETAKDASAEPPSMTQLLRR

SEQ ID NO: 38473 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKGGVSNKDIEKETAKDAAGEPPSMTQLLRR

SEQ ID NO: 38474 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKGGVSNKDIEKETAKDAASEPPSMTQLLRR

SEQ ID NO: 38475 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKGGVSNKDIEKETAKDAAAEPPSMTQLLRR

SEQ ID NO: 38476 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKDGVSNKDIEKETAKDGGGEPPSMTQLLRR

SEQ ID NO: 38477 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKDGVSNKDIEKETAKDGGSEPPSMTQLLRR

SEQ ID NO: 38478 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKDGVSNKDIEKETAKDGGAEPPSMTQLLRR

SEQ ID NO: 38479 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKDGVSNKDIEKETAKDGSGEPPSMTQLLRR

SEQ ID NO: 38480 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKDGVSNKDIEKETAKDGSSEPPSMTQLLRR

SEQ ID NO: 38481 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKDGVSNKDIEKETAKDGSAEPPSMTQLLRR

SEQ ID NO: 38482 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKDGVSNKDIEKETAKDGAGEPPSMTQLLRR

SEQ ID NO: 38483 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKDGVSNKDIEKETAKDGASEPPSMTQLLRR

SEQ ID NO: 38484 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKDGVSNKDIEKETAKDGAAEPPSMTQLLRR

SEQ ID NO: 38485 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKDGVSNKDIEKETAKDSGGEPPSMTQLLRR

SEQ ID NO: 38486 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKDGVSNKDIEKETAKDSGSEPPSMTQLLRR

SEQ ID NO: 38487 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKDGVSNKDIEKETAKDSGAEPPSMTQLLRR

SEQ ID NO: 38488 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKDGVSNKDIEKETAKDSSGEPPSMTQLLRR

SEQ ID NO: 38489 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKDGVSNKDIEKETAKDSSSEPPSMTQLLRR

SEQ ID NO: 38490 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKDGVSNKDIEKETAKDSSAEPPSMTQLLRR

SEQ ID NO: 38491 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKDGVSNKDIEKETAKDSAGEPPSMTQLLRR

SEQ ID NO: 38492 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKDGVSNKDIEKETAKDSASEPPSMTQLLRR

SEQ ID NO: 38493 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKDGVSNKDIEKETAKDSAAEPPSMTQLLRR

SEQ ID NO: 38494 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKDGVSNKDIEKETAKDAGGEPPSMTQLLRR

SEQ ID NO: 38495 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKDGVSNKDIEKETAKDAGSEPPSMTQLLRR

SEQ ID NO: 38496 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKDGVSNKDIEKETAKDAGAEPPSMTQLLRR

SEQ ID NO: 38497 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKDGVSNKDIEKETAKDASGEPPSMTQLLRR

SEQ ID NO: 38498 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKDGVSNKDIEKETAKDASSEPPSMTQLLRR

SEQ ID NO: 38499 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKDGVSNKDIEKETAKDASAEPPSMTQLLRR

SEQ ID NO: 38500 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKDGVSNKDIEKETAKDAAGEPPSMTQLLRR

SEQ ID NO: 38501 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKDGVSNKDIEKETAKDAASEPPSMTQLLRR

SEQ ID NO: 38502 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKDGVSNKDIEKETAKDAAAEPPSMTQLLRR

SEQ ID NO: 38503 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKHGVSNKDIEKETAKDGGGEPPSMTQLLRR

SEQ ID NO: 38504 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKHGVSNKDIEKETAKDGGSEPPSMTQLLRR

SEQ ID NO: 38505 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKHGVSNKDIEKETAKDGGAEPPSMTQLLRR

SEQ ID NO: 38506 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKHGVSNKDIEKETAKDGSGEPPSMTQLLRR

SEQ ID NO: 38507 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKHGVSNKDIEKETAKDGSSEPPSMTQLLRR

SEQ ID NO: 38508 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKHGVSNKDIEKETAKDGSAEPPSMTQLLRR

SEQ ID NO: 38509 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKHGVSNKDIEKETAKDGAGEPPSMTQLLRR

SEQ ID NO: 38510 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKHGVSNKDIEKETAKDGASEPPSMTQLLRR

SEQ ID NO: 38511 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKHGVSNKDIEKETAKDGAAEPPSMTQLLRR

SEQ ID NO: 38512 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKHGVSNKDIEKETAKDSGGEPPSMTQLLRR

SEQ ID NO: 38513 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKHGVSNKDIEKETAKDSGSEPPSMTQLLRR

SEQ ID NO: 38514 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKHGVSNKDIEKETAKDSGAEPPSMTQLLRR

SEQ ID NO: 38515 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKHGVSNKDIEKETAKDSSGEPPSMTQLLRR

SEQ ID NO: 38516 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKHGVSNKDIEKETAKDSSSEPPSMTQLLRR

SEQ ID NO: 38517 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKHGVSNKDIEKETAKDSSAEPPSMTQLLRR

SEQ ID NO: 38518 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKHGVSNKDIEKETAKDSAGEPPSMTQLLRR

SEQ ID NO: 38519 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKHGVSNKDIEKETAKDSASEPPSMTQLLRR

SEQ ID NO: 38520 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKHGVSNKDIEKETAKDSAAEPPSMTQLLRR

SEQ ID NO: 38521 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKHGVSNKDIEKETAKDAGGEPPSMTQLLRR

SEQ ID NO: 38522 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKHGVSNKDIEKETAKDAGSEPPSMTQLLRR

SEQ ID NO: 38523 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKHGVSNKDIEKETAKDAGAEPPSMTQLLRR

SEQ ID NO: 38524 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKHGVSNKDIEKETAKDASGEPPSMTQLLRR

SEQ ID NO: 38525 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKHGVSNKDIEKETAKDASSEPPSMTQLLRR

SEQ ID NO: 38526 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKHGVSNKDIEKETAKDASAEPPSMTQLLRR

SEQ ID NO: 38527 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKHGVSNKDIEKETAKDAAGEPPSMTQLLRR

SEQ ID NO: 38528 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKHGVSNKDIEKETAKDAASEPPSMTQLLRR

SEQ ID NO: 38529 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKHGVSNKDIEKETAKDAAAEPPSMTQLLRR

SEQ ID NO: 38530 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKYGVSNKDIEKETAKDGGGEPPSMTQLLRR

SEQ ID NO: 38531 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKYGVSNKDIEKETAKDGGSEPPSMTQLLRR

SEQ ID NO: 38532 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKYGVSNKDIEKETAKDGGAEPPSMTQLLRR

SEQ ID NO: 38533 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKYGVSNKDIEKETAKDGSGEPPSMTQLLRR

SEQ ID NO: 38534 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKYGVSNKDIEKETAKDGSSEPPSMTQLLRR

SEQ ID NO: 38535 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKYGVSNKDIEKETAKDGSAEPPSMTQLLRR

SEQ ID NO: 38536 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKYGVSNKDIEKETAKDGAGEPPSMTQLLRR

SEQ ID NO: 38537 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKYGVSNKDIEKETAKDGASEPPSMTQLLRR

SEQ ID NO: 38538 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKYGVSNKDIEKETAKDGAAEPPSMTQLLRR

SEQ ID NO: 38539 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKYGVSNKDIEKETAKDSGGEPPSMTQLLRR

SEQ ID NO: 38540 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKYGVSNKDIEKETAKDSGSEPPSMTQLLRR

SEQ ID NO: 38541 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKYGVSNKDIEKETAKDSGAEPPSMTQLLRR

SEQ ID NO: 38542 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKYGVSNKDIEKETAKDSSGEPPSMTQLLRR

SEQ ID NO: 38543 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKYGVSNKDIEKETAKDSSSEPPSMTQLLRR

SEQ ID NO: 38544 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKYGVSNKDIEKETAKDSSAEPPSMTQLLRR

SEQ ID NO: 38545 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKYGVSNKDIEKETAKDSAGEPPSMTQLLRR

SEQ ID NO: 38546 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKYGVSNKDIEKETAKDSASEPPSMTQLLRR

SEQ ID NO: 38547 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKYGVSNKDIEKETAKDSAAEPPSMTQLLRR

SEQ ID NO: 38548 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKYGVSNKDIEKETAKDAGGEPPSMTQLLRR

SEQ ID NO: 38549 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKYGVSNKDIEKETAKDAGSEPPSMTQLLRR

SEQ ID NO: 38550 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKYGVSNKDIEKETAKDAGAEPPSMTQLLRR

SEQ ID NO: 38551 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKYGVSNKDIEKETAKDASGEPPSMTQLLRR

SEQ ID NO: 38552 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKYGVSNKDIEKETAKDASSEPPSMTQLLRR

SEQ ID NO: 38553 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKYGVSNKDIEKETAKDASAEPPSMTQLLRR

SEQ ID NO: 38554 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKYGVSNKDIEKETAKDAAGEPPSMTQLLRR

SEQ ID NO: 38555 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKYGVSNKDIEKETAKDAASEPPSMTQLLRR

SEQ ID NO: 38556 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKYGVSNKDIEKETAKDAAAEPPSMTQLLRR

SEQ ID NO: 38557 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKKGVSNKDIEKETAKDGGGEPPSMTQLLRR

SEQ ID NO: 38558 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKKGVSNKDIEKETAKDGGSEPPSMTQLLRR

SEQ ID NO: 38559 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKKGVSNKDIEKETAKDGGAEPPSMTQLLRR

SEQ ID NO: 38560 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKKGVSNKDIEKETAKDGSGEPPSMTQLLRR

SEQ ID NO: 38561 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKKGVSNKDIEKETAKDGSSEPPSMTQLLRR

SEQ ID NO: 38562 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKKGVSNKDIEKETAKDGSAEPPSMTQLLRR

SEQ ID NO: 38563 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKKGVSNKDIEKETAKDGAGEPPSMTQLLRR

SEQ ID NO: 38564 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKKGVSNKDIEKETAKDGASEPPSMTQLLRR

SEQ ID NO: 38565 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKKGVSNKDIEKETAKDGAAEPPSMTQLLRR

SEQ ID NO: 38566 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKKGVSNKDIEKETAKDSGGEPPSMTQLLRR

SEQ ID NO: 38567 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKKGVSNKDIEKETAKDSGSEPPSMTQLLRR

SEQ ID NO: 38568 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKKGVSNKDIEKETAKDSGAEPPSMTQLLRR

SEQ ID NO: 38569 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKKGVSNKDIEKETAKDSSGEPPSMTQLLRR

SEQ ID NO: 38570 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKKGVSNKDIEKETAKDSSSEPPSMTQLLRR

SEQ ID NO: 38571 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKKGVSNKDIEKETAKDSSAEPPSMTQLLRR

SEQ ID NO: 38572 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKKGVSNKDIEKETAKDSAGEPPSMTQLLRR

SEQ ID NO: 38573 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKKGVSNKDIEKETAKDSASEPPSMTQLLRR

SEQ ID NO: 38574 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKKGVSNKDIEKETAKDSAAEPPSMTQLLRR

SEQ ID NO: 38575 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKKGVSNKDIEKETAKDAGGEPPSMTQLLRR

SEQ ID NO: 38576 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKKGVSNKDIEKETAKDAGSEPPSMTQLLRR

SEQ ID NO: 38577 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKKGVSNKDIEKETAKDAGAEPPSMTQLLRR

SEQ ID NO: 38578 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKKGVSNKDIEKETAKDASGEPPSMTQLLRR

SEQ ID NO: 38579 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKKGVSNKDIEKETAKDASSEPPSMTQLLRR

SEQ ID NO: 38580 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKKGVSNKDIEKETAKDASAEPPSMTQLLRR

SEQ ID NO: 38581 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKKGVSNKDIEKETAKDAAGEPPSMTQLLRR

SEQ ID NO: 38582 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKKGVSNKDIEKETAKDAASEPPSMTQLLRR

SEQ ID NO: 38583 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKKGVSNKDIEKETAKDAAAEPPSMTQLLRR

SEQ ID NO: 38584 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKNGVSNKDIEKETAKDGGGEPPSMTQLLRR

SEQ ID NO: 38585 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKNGVSNKDIEKETAKDGGSEPPSMTQLLRR

SEQ ID NO: 38586 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKNGVSNKDIEKETAKDGGAEPPSMTQLLRR

SEQ ID NO: 38587 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKNGVSNKDIEKETAKDGSGEPPSMTQLLRR

SEQ ID NO: 38588 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKNGVSNKDIEKETAKDGSSEPPSMTQLLRR

SEQ ID NO: 38589 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKNGVSNKDIEKETAKDGSAEPPSMTQLLRR

SEQ ID NO: 38590 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKNGVSNKDIEKETAKDGAGEPPSMTQLLRR

SEQ ID NO: 38591 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKNGVSNKDIEKETAKDGASEPPSMTQLLRR

SEQ ID NO: 38592 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKNGVSNKDIEKETAKDGAAEPPSMTQLLRR

SEQ ID NO: 38593 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKNGVSNKDIEKETAKDSGGEPPSMTQLLRR

SEQ ID NO: 38594 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKNGVSNKDIEKETAKDSGSEPPSMTQLLRR

SEQ ID NO: 38595 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKNGVSNKDIEKETAKDSGAEPPSMTQLLRR

SEQ ID NO: 38596 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKNGVSNKDIEKETAKDSSGEPPSMTQLLRR

SEQ ID NO: 38597 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKNGVSNKDIEKETAKDSSSEPPSMTQLLRR

SEQ ID NO: 38598 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKNGVSNKDIEKETAKDSSAEPPSMTQLLRR

SEQ ID NO: 38599 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKNGVSNKDIEKETAKDSAGEPPSMTQLLRR

SEQ ID NO: 38600 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKNGVSNKDIEKETAKDSASEPPSMTQLLRR

SEQ ID NO: 38601 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKNGVSNKDIEKETAKDSAAEPPSMTQLLRR

SEQ ID NO: 38602 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKNGVSNKDIEKETAKDAGGEPPSMTQLLRR

SEQ ID NO: 38603 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKNGVSNKDIEKETAKDAGSEPPSMTQLLRR

SEQ ID NO: 38604 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKNGVSNKDIEKETAKDAGAEPPSMTQLLRR

SEQ ID NO: 38605 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKNGVSNKDIEKETAKDASGEPPSMTQLLRR

SEQ ID NO: 38606 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKNGVSNKDIEKETAKDASSEPPSMTQLLRR

SEQ ID NO: 38607 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKNGVSNKDIEKETAKDASAEPPSMTQLLRR

SEQ ID NO: 38608 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKNGVSNKDIEKETAKDAAGEPPSMTQLLRR

SEQ ID NO: 38609 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKNGVSNKDIEKETAKDAASEPPSMTQLLRR

SEQ ID NO: 38610 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKNGVSNKDIEKETAKDAAAEPPSMTQLLRR

SEQ ID NO: 38611 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKMGVSNKDIEKETAKDGGGEPPSMTQLLRR

SEQ ID NO: 38612 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKMGVSNKDIEKETAKDGGSEPPSMTQLLRR

SEQ ID NO: 38613 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKMGVSNKDIEKETAKDGGAEPPSMTQLLRR

SEQ ID NO: 38614 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKMGVSNKDIEKETAKDGSGEPPSMTQLLRR

SEQ ID NO: 38615 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKMGVSNKDIEKETAKDGSSEPPSMTQLLRR

SEQ ID NO: 38616 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKMGVSNKDIEKETAKDGSAEPPSMTQLLRR

SEQ ID NO: 38617 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKMGVSNKDIEKETAKDGAGEPPSMTQLLRR

SEQ ID NO: 38618 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKMGVSNKDIEKETAKDGASEPPSMTQLLRR

SEQ ID NO: 38619 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKMGVSNKDIEKETAKDGAAEPPSMTQLLRR

SEQ ID NO: 38620 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKMGVSNKDIEKETAKDSGGEPPSMTQLLRR

SEQ ID NO: 38621 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKMGVSNKDIEKETAKDSGSEPPSMTQLLRR

SEQ ID NO: 38622 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKMGVSNKDIEKETAKDSGAEPPSMTQLLRR

SEQ ID NO: 38623 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKMGVSNKDIEKETAKDSSGEPPSMTQLLRR

SEQ ID NO: 38624 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKMGVSNKDIEKETAKDSSSEPPSMTQLLRR

SEQ ID NO: 38625 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKMGVSNKDIEKETAKDSSAEPPSMTQLLRR

SEQ ID NO: 38626 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKMGVSNKDIEKETAKDSAGEPPSMTQLLRR

SEQ ID NO: 38627 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKMGVSNKDIEKETAKDSASEPPSMTQLLRR

SEQ ID NO: 38628 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKMGVSNKDIEKETAKDSAAEPPSMTQLLRR

SEQ ID NO: 38629 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKMGVSNKDIEKETAKDAGGEPPSMTQLLRR

SEQ ID NO: 38630 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKMGVSNKDIEKETAKDAGSEPPSMTQLLRR

SEQ ID NO: 38631 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKMGVSNKDIEKETAKDAGAEPPSMTQLLRR

SEQ ID NO: 38632 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKMGVSNKDIEKETAKDASGEPPSMTQLLRR

SEQ ID NO: 38633 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKMGVSNKDIEKETAKDASSEPPSMTQLLRR

SEQ ID NO: 38634 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKMGVSNKDIEKETAKDASAEPPSMTQLLRR

SEQ ID NO: 38635 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKMGVSNKDIEKETAKDAAGEPPSMTQLLRR

SEQ ID NO: 38636 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKMGVSNKDIEKETAKDAASEPPSMTQLLRR

SEQ ID NO: 38637 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKMGVSNKDIEKETAKDAAAEPPSMTQLLRR

SEQ ID NO: 38638 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKCGVSNKDIEKETAKDGGGEPPSMTQLLRR

SEQ ID NO: 38639 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKCGVSNKDIEKETAKDGGSEPPSMTQLLRR

SEQ ID NO: 38640 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKCGVSNKDIEKETAKDGGAEPPSMTQLLRR

SEQ ID NO: 38641 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKCGVSNKDIEKETAKDGSGEPPSMTQLLRR

SEQ ID NO: 38642 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKCGVSNKDIEKETAKDGSSEPPSMTQLLRR

SEQ ID NO: 38643 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKCGVSNKDIEKETAKDGSAEPPSMTQLLRR

SEQ ID NO: 38644 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKCGVSNKDIEKETAKDGAGEPPSMTQLLRR

SEQ ID NO: 38645 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKCGVSNKDIEKETAKDGASEPPSMTQLLRR

SEQ ID NO: 38646 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKCGVSNKDIEKETAKDGAAEPPSMTQLLRR

SEQ ID NO: 38647 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKCGVSNKDIEKETAKDSGGEPPSMTQLLRR

SEQ ID NO: 38648 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKCGVSNKDIEKETAKDSGSEPPSMTQLLRR

SEQ ID NO: 38649 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKCGVSNKDIEKETAKDSGAEPPSMTQLLRR

SEQ ID NO: 38650 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKCGVSNKDIEKETAKDSSGEPPSMTQLLRR

SEQ ID NO: 38651 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKCGVSNKDIEKETAKDSSSEPPSMTQLLRR

SEQ ID NO: 38652 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKCGVSNKDIEKETAKDSSAEPPSMTQLLRR

SEQ ID NO: 38653 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKCGVSNKDIEKETAKDSAGEPPSMTQLLRR

SEQ ID NO: 38654 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKCGVSNKDIEKETAKDSASEPPSMTQLLRR

SEQ ID NO: 38655 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKCGVSNKDIEKETAKDSAAEPPSMTQLLRR

SEQ ID NO: 38656 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKCGVSNKDIEKETAKDAGGEPPSMTQLLRR

SEQ ID NO: 38657 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKCGVSNKDIEKETAKDAGSEPPSMTQLLRR

SEQ ID NO: 38658 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKCGVSNKDIEKETAKDAGAEPPSMTQLLRR

SEQ ID NO: 38659 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKCGVSNKDIEKETAKDASGEPPSMTQLLRR

SEQ ID NO: 38660 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKCGVSNKDIEKETAKDASSEPPSMTQLLRR

SEQ ID NO: 38661 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKCGVSNKDIEKETAKDASAEPPSMTQLLRR

SEQ ID NO: 38662 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKCGVSNKDIEKETAKDAAGEPPSMTQLLRR

SEQ ID NO: 38663 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKCGVSNKDIEKETAKDAASEPPSMTQLLRR

SEQ ID NO: 38664 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKCGVSNKDIEKETAKDAAAEPPSMTQLLRR

SEQ ID NO: 38665 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKSGVSNKDIEKETAKDGGGEPPSMTQLLRR

SEQ ID NO: 38666 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKSGVSNKDIEKETAKDGGSEPPSMTQLLRR

SEQ ID NO: 38667 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKSGVSNKDIEKETAKDGGAEPPSMTQLLRR

SEQ ID NO: 38668 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKSGVSNKDIEKETAKDGSGEPPSMTQLLRR

SEQ ID NO: 38669 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKSGVSNKDIEKETAKDGSSEPPSMTQLLRR

SEQ ID NO: 38670 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKSGVSNKDIEKETAKDGSAEPPSMTQLLRR

SEQ ID NO: 38671 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKSGVSNKDIEKETAKDGAGEPPSMTQLLRR

SEQ ID NO: 38672 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKSGVSNKDIEKETAKDGASEPPSMTQLLRR

SEQ ID NO: 38673 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKSGVSNKDIEKETAKDGAAEPPSMTQLLRR

SEQ ID NO: 38674 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKSGVSNKDIEKETAKDSGGEPPSMTQLLRR

SEQ ID NO: 38675 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKSGVSNKDIEKETAKDSGSEPPSMTQLLRR

SEQ ID NO: 38676 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKSGVSNKDIEKETAKDSGAEPPSMTQLLRR

SEQ ID NO: 38677 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKSGVSNKDIEKETAKDSSGEPPSMTQLLRR

SEQ ID NO: 38678 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKSGVSNKDIEKETAKDSSSEPPSMTQLLRR

SEQ ID NO: 38679 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKSGVSNKDIEKETAKDSSAEPPSMTQLLRR

SEQ ID NO: 38680 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKSGVSNKDIEKETAKDSAGEPPSMTQLLRR

SEQ ID NO: 38681 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKSGVSNKDIEKETAKDSASEPPSMTQLLRR

SEQ ID NO: 38682 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKSGVSNKDIEKETAKDSAAEPPSMTQLLRR

SEQ ID NO: 38683 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKSGVSNKDIEKETAKDAGGEPPSMTQLLRR

SEQ ID NO: 38684 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKSGVSNKDIEKETAKDAGSEPPSMTQLLRR

SEQ ID NO: 38685 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKSGVSNKDIEKETAKDAGAEPPSMTQLLRR

SEQ ID NO: 38686 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKSGVSNKDIEKETAKDASGEPPSMTQLLRR

SEQ ID NO: 38687 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKSGVSNKDIEKETAKDASSEPPSMTQLLRR

SEQ ID NO: 38688 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKSGVSNKDIEKETAKDASAEPPSMTQLLRR

SEQ ID NO: 38689 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKSGVSNKDIEKETAKDAAGEPPSMTQLLRR

SEQ ID NO: 38690 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKSGVSNKDIEKETAKDAASEPPSMTQLLRR

SEQ ID NO: 38691 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKSGVSNKDIEKETAKDAAAEPPSMTQLLRR

SEQ ID NO: 38692 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKAGVSNKDIEKETAKDGGGEPPSMTQLLRR

SEQ ID NO: 38693 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKAGVSNKDIEKETAKDGGSEPPSMTQLLRR

SEQ ID NO: 38694 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKAGVSNKDIEKETAKDGGAEPPSMTQLLRR

SEQ ID NO: 38695 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKAGVSNKDIEKETAKDGSGEPPSMTQLLRR

SEQ ID NO: 38696 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKAGVSNKDIEKETAKDGSSEPPSMTQLLRR

SEQ ID NO: 38697 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKAGVSNKDIEKETAKDGSAEPPSMTQLLRR

SEQ ID NO: 38698 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKAGVSNKDIEKETAKDGAGEPPSMTQLLRR

SEQ ID NO: 38699 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKAGVSNKDIEKETAKDGASEPPSMTQLLRR

SEQ ID NO: 38700 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKAGVSNKDIEKETAKDGAAEPPSMTQLLRR

SEQ ID NO: 38701 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKAGVSNKDIEKETAKDSGGEPPSMTQLLRR

SEQ ID NO: 38702 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKAGVSNKDIEKETAKDSGSEPPSMTQLLRR

SEQ ID NO: 38703 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKAGVSNKDIEKETAKDSGAEPPSMTQLLRR

SEQ ID NO: 38704 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKAGVSNKDIEKETAKDSSGEPPSMTQLLRR

SEQ ID NO: 38705 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKAGVSNKDIEKETAKDSSSEPPSMTQLLRR

SEQ ID NO: 38706 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKAGVSNKDIEKETAKDSSAEPPSMTQLLRR

SEQ ID NO: 38707 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKAGVSNKDIEKETAKDSAGEPPSMTQLLRR

SEQ ID NO: 38708 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKAGVSNKDIEKETAKDSASEPPSMTQLLRR

SEQ ID NO: 38709 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKAGVSNKDIEKETAKDSAAEPPSMTQLLRR

SEQ ID NO: 38710 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKAGVSNKDIEKETAKDAGGEPPSMTQLLRR

SEQ ID NO: 38711 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKAGVSNKDIEKETAKDAGSEPPSMTQLLRR

SEQ ID NO: 38712 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKAGVSNKDIEKETAKDAGAEPPSMTQLLRR

SEQ ID NO: 38713 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKAGVSNKDIEKETAKDASGEPPSMTQLLRR

SEQ ID NO: 38714 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKAGVSNKDIEKETAKDASSEPPSMTQLLRR

SEQ ID NO: 38715 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKAGVSNKDIEKETAKDASAEPPSMTQLLRR

SEQ ID NO: 38716 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKAGVSNKDIEKETAKDAAGEPPSMTQLLRR

SEQ ID NO: 38717 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKAGVSNKDIEKETAKDAASEPPSMTQLLRR

SEQ ID NO: 38718 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKAGVSNKDIEKETAKDAAAEPPSMTQLLRR

SEQ ID NO: 38719 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKGGVSNKDIEKETAKDGGGEPPSMTQLLRR

SEQ ID NO: 38720 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKGGVSNKDIEKETAKDGGSEPPSMTQLLRR

SEQ ID NO: 38721 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKGGVSNKDIEKETAKDGGAEPPSMTQLLRR

SEQ ID NO: 38722 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKGGVSNKDIEKETAKDGSGEPPSMTQLLRR

SEQ ID NO: 38723 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKGGVSNKDIEKETAKDGSSEPPSMTQLLRR

SEQ ID NO: 38724 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKGGVSNKDIEKETAKDGSAEPPSMTQLLRR

SEQ ID NO: 38725 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKGGVSNKDIEKETAKDGAGEPPSMTQLLRR

SEQ ID NO: 38726 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKGGVSNKDIEKETAKDGASEPPSMTQLLRR

SEQ ID NO: 38727 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKGGVSNKDIEKETAKDGAAEPPSMTQLLRR

SEQ ID NO: 38728 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKGGVSNKDIEKETAKDSGGEPPSMTQLLRR

SEQ ID NO: 38729 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKGGVSNKDIEKETAKDSGSEPPSMTQLLRR

SEQ ID NO: 38730 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKGGVSNKDIEKETAKDSGAEPPSMTQLLRR

SEQ ID NO: 38731 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKGGVSNKDIEKETAKDSSGEPPSMTQLLRR

SEQ ID NO: 38732 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKGGVSNKDIEKETAKDSSSEPPSMTQLLRR

SEQ ID NO: 38733 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKGGVSNKDIEKETAKDSSAEPPSMTQLLRR

SEQ ID NO: 38734 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKGGVSNKDIEKETAKDSAGEPPSMTQLLRR

SEQ ID NO: 38735 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKGGVSNKDIEKETAKDSASEPPSMTQLLRR

SEQ ID NO: 38736 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKGGVSNKDIEKETAKDSAAEPPSMTQLLRR

SEQ ID NO: 38737 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKGGVSNKDIEKETAKDAGGEPPSMTQLLRR

SEQ ID NO: 38738 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKGGVSNKDIEKETAKDAGSEPPSMTQLLRR

SEQ ID NO: 38739 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKGGVSNKDIEKETAKDAGAEPPSMTQLLRR

SEQ ID NO: 38740 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKGGVSNKDIEKETAKDASGEPPSMTQLLRR

SEQ ID NO: 38741 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKGGVSNKDIEKETAKDASSEPPSMTQLLRR

SEQ ID NO: 38742 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKGGVSNKDIEKETAKDASAEPPSMTQLLRR

SEQ ID NO: 38743 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKGGVSNKDIEKETAKDAAGEPPSMTQLLRR

SEQ ID NO: 38744 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKGGVSNKDIEKETAKDAASEPPSMTQLLRR

SEQ ID NO: 38745 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKGGVSNKDIEKETAKDAAAEPPSMTQLLRR

SEQ ID NO: 38746 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKDGVSNKDIEKETAKDGGGEPPSMTQLLRR

SEQ ID NO: 38747 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKDGVSNKDIEKETAKDGGSEPPSMTQLLRR

SEQ ID NO: 38748 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKDGVSNKDIEKETAKDGGAEPPSMTQLLRR

SEQ ID NO: 38749 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKDGVSNKDIEKETAKDGSGEPPSMTQLLRR

SEQ ID NO: 38750 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKDGVSNKDIEKETAKDGSSEPPSMTQLLRR

SEQ ID NO: 38751 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKDGVSNKDIEKETAKDGSAEPPSMTQLLRR

SEQ ID NO: 38752 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKDGVSNKDIEKETAKDGAGEPPSMTQLLRR

SEQ ID NO: 38753 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKDGVSNKDIEKETAKDGASEPPSMTQLLRR

SEQ ID NO: 38754 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKDGVSNKDIEKETAKDGAAEPPSMTQLLRR

SEQ ID NO: 38755 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKDGVSNKDIEKETAKDSGGEPPSMTQLLRR

SEQ ID NO: 38756 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKDGVSNKDIEKETAKDSGSEPPSMTQLLRR

SEQ ID NO: 38757 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKDGVSNKDIEKETAKDSGAEPPSMTQLLRR

SEQ ID NO: 38758 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKDGVSNKDIEKETAKDSSGEPPSMTQLLRR

SEQ ID NO: 38759 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKDGVSNKDIEKETAKDSSSEPPSMTQLLRR

SEQ ID NO: 38760 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKDGVSNKDIEKETAKDSSAEPPSMTQLLRR

SEQ ID NO: 38761 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKDGVSNKDIEKETAKDSAGEPPSMTQLLRR

SEQ ID NO: 38762 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKDGVSNKDIEKETAKDSASEPPSMTQLLRR

SEQ ID NO: 38763 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKDGVSNKDIEKETAKDSAAEPPSMTQLLRR

SEQ ID NO: 38764 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKDGVSNKDIEKETAKDAGGEPPSMTQLLRR

SEQ ID NO: 38765 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKDGVSNKDIEKETAKDAGSEPPSMTQLLRR

SEQ ID NO: 38766 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKDGVSNKDIEKETAKDAGAEPPSMTQLLRR

SEQ ID NO: 38767 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKDGVSNKDIEKETAKDASGEPPSMTQLLRR

SEQ ID NO: 38768 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKDGVSNKDIEKETAKDASSEPPSMTQLLRR

SEQ ID NO: 38769 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKDGVSNKDIEKETAKDASAEPPSMTQLLRR

SEQ ID NO: 38770 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKDGVSNKDIEKETAKDAAGEPPSMTQLLRR

SEQ ID NO: 38771 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKDGVSNKDIEKETAKDAASEPPSMTQLLRR

SEQ ID NO: 38772 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKDGVSNKDIEKETAKDAAAEPPSMTQLLRR

SEQ ID NO: 38773 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKHGVSNKDIEKETAKDGGGEPPSMTQLLRR

SEQ ID NO: 38774 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKHGVSNKDIEKETAKDGGSEPPSMTQLLRR

SEQ ID NO: 38775 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKHGVSNKDIEKETAKDGGAEPPSMTQLLRR

SEQ ID NO: 38776 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKHGVSNKDIEKETAKDGSGEPPSMTQLLRR

SEQ ID NO: 38777 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKHGVSNKDIEKETAKDGSSEPPSMTQLLRR

SEQ ID NO: 38778 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKHGVSNKDIEKETAKDGSAEPPSMTQLLRR

SEQ ID NO: 38779 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKHGVSNKDIEKETAKDGAGEPPSMTQLLRR

SEQ ID NO: 38780 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKHGVSNKDIEKETAKDGASEPPSMTQLLRR

SEQ ID NO: 38781 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKHGVSNKDIEKETAKDGAAEPPSMTQLLRR

SEQ ID NO: 38782 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKHGVSNKDIEKETAKDSGGEPPSMTQLLRR

SEQ ID NO: 38783 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKHGVSNKDIEKETAKDSGSEPPSMTQLLRR

SEQ ID NO: 38784 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKHGVSNKDIEKETAKDSGAEPPSMTQLLRR

SEQ ID NO: 38785 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKHGVSNKDIEKETAKDSSGEPPSMTQLLRR

SEQ ID NO: 38786 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKHGVSNKDIEKETAKDSSSEPPSMTQLLRR

SEQ ID NO: 38787 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKHGVSNKDIEKETAKDSSAEPPSMTQLLRR

SEQ ID NO: 38788 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKHGVSNKDIEKETAKDSAGEPPSMTQLLRR

SEQ ID NO: 38789 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKHGVSNKDIEKETAKDSASEPPSMTQLLRR

SEQ ID NO: 38790 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKHGVSNKDIEKETAKDSAAEPPSMTQLLRR

SEQ ID NO: 38791 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKHGVSNKDIEKETAKDAGGEPPSMTQLLRR

SEQ ID NO: 38792 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKHGVSNKDIEKETAKDAGSEPPSMTQLLRR

SEQ ID NO: 38793 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKHGVSNKDIEKETAKDAGAEPPSMTQLLRR

SEQ ID NO: 38794 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKHGVSNKDIEKETAKDASGEPPSMTQLLRR

SEQ ID NO: 38795 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKHGVSNKDIEKETAKDASSEPPSMTQLLRR

SEQ ID NO: 38796 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKHGVSNKDIEKETAKDASAEPPSMTQLLRR

SEQ ID NO: 38797 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKHGVSNKDIEKETAKDAAGEPPSMTQLLRR

SEQ ID NO: 38798 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKHGVSNKDIEKETAKDAASEPPSMTQLLRR

SEQ ID NO: 38799 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKHGVSNKDIEKETAKDAAAEPPSMTQLLRR

SEQ ID NO: 38800 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKYGVSNKDIEKETAKDGGGEPPSMTQLLRR

SEQ ID NO: 38801 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKYGVSNKDIEKETAKDGGSEPPSMTQLLRR

SEQ ID NO: 38802 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKYGVSNKDIEKETAKDGGAEPPSMTQLLRR

SEQ ID NO: 38803 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKYGVSNKDIEKETAKDGSGEPPSMTQLLRR

SEQ ID NO: 38804 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKYGVSNKDIEKETAKDGSSEPPSMTQLLRR

SEQ ID NO: 38805 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKYGVSNKDIEKETAKDGSAEPPSMTQLLRR

SEQ ID NO: 38806 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKYGVSNKDIEKETAKDGAGEPPSMTQLLRR

SEQ ID NO: 38807 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKYGVSNKDIEKETAKDGASEPPSMTQLLRR

SEQ ID NO: 38808 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKYGVSNKDIEKETAKDGAAEPPSMTQLLRR

SEQ ID NO: 38809 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKYGVSNKDIEKETAKDSGGEPPSMTQLLRR

SEQ ID NO: 38810 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKYGVSNKDIEKETAKDSGSEPPSMTQLLRR

SEQ ID NO: 38811 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKYGVSNKDIEKETAKDSGAEPPSMTQLLRR

SEQ ID NO: 38812 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKYGVSNKDIEKETAKDSSGEPPSMTQLLRR

SEQ ID NO: 38813 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKYGVSNKDIEKETAKDSSSEPPSMTQLLRR

SEQ ID NO: 38814 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKYGVSNKDIEKETAKDSSAEPPSMTQLLRR

SEQ ID NO: 38815 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKYGVSNKDIEKETAKDSAGEPPSMTQLLRR

SEQ ID NO: 38816 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKYGVSNKDIEKETAKDSASEPPSMTQLLRR

SEQ ID NO: 38817 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKYGVSNKDIEKETAKDSAAEPPSMTQLLRR

SEQ ID NO: 38818 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKYGVSNKDIEKETAKDAGGEPPSMTQLLRR

SEQ ID NO: 38819 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKYGVSNKDIEKETAKDAGSEPPSMTQLLRR

SEQ ID NO: 38820 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKYGVSNKDIEKETAKDAGAEPPSMTQLLRR

SEQ ID NO: 38821 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKYGVSNKDIEKETAKDASGEPPSMTQLLRR

SEQ ID NO: 38822 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKYGVSNKDIEKETAKDASSEPPSMTQLLRR

SEQ ID NO: 38823 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKYGVSNKDIEKETAKDASAEPPSMTQLLRR

SEQ ID NO: 38824 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKYGVSNKDIEKETAKDAAGEPPSMTQLLRR

SEQ ID NO: 38825 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKYGVSNKDIEKETAKDAASEPPSMTQLLRR

SEQ ID NO: 38826 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKYGVSNKDIEKETAKDAAAEPPSMTQLLRR

SEQ ID NO: 38827 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKKGVSNKDIEKETAKDGGGEPPSMTQLLRR

SEQ ID NO: 38828 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKKGVSNKDIEKETAKDGGSEPPSMTQLLRR

SEQ ID NO: 38829 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKKGVSNKDIEKETAKDGGAEPPSMTQLLRR

SEQ ID NO: 38830 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKKGVSNKDIEKETAKDGSGEPPSMTQLLRR

SEQ ID NO: 38831 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKKGVSNKDIEKETAKDGSSEPPSMTQLLRR

SEQ ID NO: 38832 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKKGVSNKDIEKETAKDGSAEPPSMTQLLRR

SEQ ID NO: 38833 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKKGVSNKDIEKETAKDGAGEPPSMTQLLRR

SEQ ID NO: 38834 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKKGVSNKDIEKETAKDGASEPPSMTQLLRR

SEQ ID NO: 38835 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKKGVSNKDIEKETAKDGAAEPPSMTQLLRR

SEQ ID NO: 38836 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKKGVSNKDIEKETAKDSGGEPPSMTQLLRR

SEQ ID NO: 38837 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKKGVSNKDIEKETAKDSGSEPPSMTQLLRR

SEQ ID NO: 38838 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKKGVSNKDIEKETAKDSGAEPPSMTQLLRR

SEQ ID NO: 38839 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKKGVSNKDIEKETAKDSSGEPPSMTQLLRR

SEQ ID NO: 38840 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKKGVSNKDIEKETAKDSSSEPPSMTQLLRR

SEQ ID NO: 38841 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKKGVSNKDIEKETAKDSSAEPPSMTQLLRR

SEQ ID NO: 38842 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKKGVSNKDIEKETAKDSAGEPPSMTQLLRR

SEQ ID NO: 38843 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKKGVSNKDIEKETAKDSASEPPSMTQLLRR

SEQ ID NO: 38844 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKKGVSNKDIEKETAKDSAAEPPSMTQLLRR

SEQ ID NO: 38845 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKKGVSNKDIEKETAKDAGGEPPSMTQLLRR

SEQ ID NO: 38846 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKKGVSNKDIEKETAKDAGSEPPSMTQLLRR

SEQ ID NO: 38847 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKKGVSNKDIEKETAKDAGAEPPSMTQLLRR

SEQ ID NO: 38848 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKKGVSNKDIEKETAKDASGEPPSMTQLLRR

SEQ ID NO: 38849 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKKGVSNKDIEKETAKDASSEPPSMTQLLRR

SEQ ID NO: 38850 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKKGVSNKDIEKETAKDASAEPPSMTQLLRR

SEQ ID NO: 38851 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKKGVSNKDIEKETAKDAAGEPPSMTQLLRR

SEQ ID NO: 38852 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKKGVSNKDIEKETAKDAASEPPSMTQLLRR

SEQ ID NO: 38853 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKKGVSNKDIEKETAKDAAAEPPSMTQLLRR

SEQ ID NO: 38854 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKNGVSNKDIEKETAKDGGGEPPSMTQLLRR

SEQ ID NO: 38855 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKNGVSNKDIEKETAKDGGSEPPSMTQLLRR

SEQ ID NO: 38856 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKNGVSNKDIEKETAKDGGAEPPSMTQLLRR

SEQ ID NO: 38857 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKNGVSNKDIEKETAKDGSGEPPSMTQLLRR

SEQ ID NO: 38858 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKNGVSNKDIEKETAKDGSSEPPSMTQLLRR

SEQ ID NO: 38859 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKNGVSNKDIEKETAKDGSAEPPSMTQLLRR

SEQ ID NO: 38860 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKNGVSNKDIEKETAKDGAGEPPSMTQLLRR

SEQ ID NO: 38861 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKNGVSNKDIEKETAKDGASEPPSMTQLLRR

SEQ ID NO: 38862 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKNGVSNKDIEKETAKDGAAEPPSMTQLLRR

SEQ ID NO: 38863 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKNGVSNKDIEKETAKDSGGEPPSMTQLLRR

SEQ ID NO: 38864 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKNGVSNKDIEKETAKDSGSEPPSMTQLLRR

SEQ ID NO: 38865 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKNGVSNKDIEKETAKDSGAEPPSMTQLLRR

SEQ ID NO: 38866 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKNGVSNKDIEKETAKDSSGEPPSMTQLLRR

SEQ ID NO: 38867 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKNGVSNKDIEKETAKDSSSEPPSMTQLLRR

SEQ ID NO: 38868 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKNGVSNKDIEKETAKDSSAEPPSMTQLLRR

SEQ ID NO: 38869 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKNGVSNKDIEKETAKDSAGEPPSMTQLLRR

SEQ ID NO: 38870 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKNGVSNKDIEKETAKDSASEPPSMTQLLRR

SEQ ID NO: 38871 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKNGVSNKDIEKETAKDSAAEPPSMTQLLRR

SEQ ID NO: 38872 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKNGVSNKDIEKETAKDAGGEPPSMTQLLRR

SEQ ID NO: 38873 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKNGVSNKDIEKETAKDAGSEPPSMTQLLRR

SEQ ID NO: 38874 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKNGVSNKDIEKETAKDAGAEPPSMTQLLRR

SEQ ID NO: 38875 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKNGVSNKDIEKETAKDASGEPPSMTQLLRR

SEQ ID NO: 38876 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKNGVSNKDIEKETAKDASSEPPSMTQLLRR

SEQ ID NO: 38877 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKNGVSNKDIEKETAKDASAEPPSMTQLLRR

SEQ ID NO: 38878 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKNGVSNKDIEKETAKDAAGEPPSMTQLLRR

SEQ ID NO: 38879 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKNGVSNKDIEKETAKDAASEPPSMTQLLRR

SEQ ID NO: 38880 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKNGVSNKDIEKETAKDAAAEPPSMTQLLRR

SEQ ID NO: 38881 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKMGVSNKDIEKETAKDGGGEPPSMTQLLRR

SEQ ID NO: 38882 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKMGVSNKDIEKETAKDGGSEPPSMTQLLRR

SEQ ID NO: 38883 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKMGVSNKDIEKETAKDGGAEPPSMTQLLRR

SEQ ID NO: 38884 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKMGVSNKDIEKETAKDGSGEPPSMTQLLRR

SEQ ID NO: 38885 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKMGVSNKDIEKETAKDGSSEPPSMTQLLRR

SEQ ID NO: 38886 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKMGVSNKDIEKETAKDGSAEPPSMTQLLRR

SEQ ID NO: 38887 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKMGVSNKDIEKETAKDGAGEPPSMTQLLRR

SEQ ID NO: 38888 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKMGVSNKDIEKETAKDGASEPPSMTQLLRR

SEQ ID NO: 38889 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKMGVSNKDIEKETAKDGAAEPPSMTQLLRR

SEQ ID NO: 38890 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKMGVSNKDIEKETAKDSGGEPPSMTQLLRR

SEQ ID NO: 38891 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKMGVSNKDIEKETAKDSGSEPPSMTQLLRR

SEQ ID NO: 38892 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKMGVSNKDIEKETAKDSGAEPPSMTQLLRR

SEQ ID NO: 38893 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKMGVSNKDIEKETAKDSSGEPPSMTQLLRR

SEQ ID NO: 38894 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKMGVSNKDIEKETAKDSSSEPPSMTQLLRR

SEQ ID NO: 38895 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKMGVSNKDIEKETAKDSSAEPPSMTQLLRR

SEQ ID NO: 38896 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKMGVSNKDIEKETAKDSAGEPPSMTQLLRR

SEQ ID NO: 38897 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKMGVSNKDIEKETAKDSASEPPSMTQLLRR

SEQ ID NO: 38898 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKMGVSNKDIEKETAKDSAAEPPSMTQLLRR

SEQ ID NO: 38899 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKMGVSNKDIEKETAKDAGGEPPSMTQLLRR

SEQ ID NO: 38900 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKMGVSNKDIEKETAKDAGSEPPSMTQLLRR

SEQ ID NO: 38901 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKMGVSNKDIEKETAKDAGAEPPSMTQLLRR

SEQ ID NO: 38902 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKMGVSNKDIEKETAKDASGEPPSMTQLLRR

SEQ ID NO: 38903 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKMGVSNKDIEKETAKDASSEPPSMTQLLRR

SEQ ID NO: 38904 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKMGVSNKDIEKETAKDASAEPPSMTQLLRR

SEQ ID NO: 38905 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKMGVSNKDIEKETAKDAAGEPPSMTQLLRR

SEQ ID NO: 38906 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKMGVSNKDIEKETAKDAASEPPSMTQLLRR

SEQ ID NO: 38907 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKMGVSNKDIEKETAKDAAAEPPSMTQLLRR

SEQ ID NO: 38908 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKCGVSNKDIEKETAKDGGGEPPSMTQLLRR

SEQ ID NO: 38909 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKCGVSNKDIEKETAKDGGSEPPSMTQLLRR

SEQ ID NO: 38910 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKCGVSNKDIEKETAKDGGAEPPSMTQLLRR

SEQ ID NO: 38911 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKCGVSNKDIEKETAKDGSGEPPSMTQLLRR

SEQ ID NO: 38912 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKCGVSNKDIEKETAKDGSSEPPSMTQLLRR

SEQ ID NO: 38913 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKCGVSNKDIEKETAKDGSAEPPSMTQLLRR

SEQ ID NO: 38914 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKCGVSNKDIEKETAKDGAGEPPSMTQLLRR

SEQ ID NO: 38915 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKCGVSNKDIEKETAKDGASEPPSMTQLLRR

SEQ ID NO: 38916 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKCGVSNKDIEKETAKDGAAEPPSMTQLLRR

SEQ ID NO: 38917 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKCGVSNKDIEKETAKDSGGEPPSMTQLLRR

SEQ ID NO: 38918 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKCGVSNKDIEKETAKDSGSEPPSMTQLLRR

SEQ ID NO: 38919 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKCGVSNKDIEKETAKDSGAEPPSMTQLLRR

SEQ ID NO: 38920 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKCGVSNKDIEKETAKDSSGEPPSMTQLLRR

SEQ ID NO: 38921 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKCGVSNKDIEKETAKDSSSEPPSMTQLLRR

SEQ ID NO: 38922 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKCGVSNKDIEKETAKDSSAEPPSMTQLLRR

SEQ ID NO: 38923 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKCGVSNKDIEKETAKDSAGEPPSMTQLLRR

SEQ ID NO: 38924 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKCGVSNKDIEKETAKDSASEPPSMTQLLRR

SEQ ID NO: 38925 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKCGVSNKDIEKETAKDSAAEPPSMTQLLRR

SEQ ID NO: 38926 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKCGVSNKDIEKETAKDAGGEPPSMTQLLRR

SEQ ID NO: 38927 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKCGVSNKDIEKETAKDAGSEPPSMTQLLRR

SEQ ID NO: 38928 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKCGVSNKDIEKETAKDAGAEPPSMTQLLRR

SEQ ID NO: 38929 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKCGVSNKDIEKETAKDASGEPPSMTQLLRR

SEQ ID NO: 38930 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKCGVSNKDIEKETAKDASSEPPSMTQLLRR

SEQ ID NO: 38931 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKCGVSNKDIEKETAKDASAEPPSMTQLLRR

SEQ ID NO: 38932 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKCGVSNKDIEKETAKDAAGEPPSMTQLLRR

SEQ ID NO: 38933 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKCGVSNKDIEKETAKDAASEPPSMTQLLRR

SEQ ID NO: 38934 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKCGVSNKDIEKETAKDAAAEPPSMTQLLRR

SEQ ID NO: 38935 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKSGVSNKDIEKETAKDGGGEPPSMTQLLRR

SEQ ID NO: 38936 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKSGVSNKDIEKETAKDGGSEPPSMTQLLRR

SEQ ID NO: 38937 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKSGVSNKDIEKETAKDGGAEPPSMTQLLRR

SEQ ID NO: 38938 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKSGVSNKDIEKETAKDGSGEPPSMTQLLRR

SEQ ID NO: 38939 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKSGVSNKDIEKETAKDGSSEPPSMTQLLRR

SEQ ID NO: 38940 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKSGVSNKDIEKETAKDGSAEPPSMTQLLRR

SEQ ID NO: 38941 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKSGVSNKDIEKETAKDGAGEPPSMTQLLRR

SEQ ID NO: 38942 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKSGVSNKDIEKETAKDGASEPPSMTQLLRR

SEQ ID NO: 38943 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKSGVSNKDIEKETAKDGAAEPPSMTQLLRR

SEQ ID NO: 38944 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKSGVSNKDIEKETAKDSGGEPPSMTQLLRR

SEQ ID NO: 38945 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKSGVSNKDIEKETAKDSGSEPPSMTQLLRR

SEQ ID NO: 38946 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKSGVSNKDIEKETAKDSGAEPPSMTQLLRR

SEQ ID NO: 38947 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKSGVSNKDIEKETAKDSSGEPPSMTQLLRR

SEQ ID NO: 38948 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKSGVSNKDIEKETAKDSSSEPPSMTQLLRR

SEQ ID NO: 38949 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKSGVSNKDIEKETAKDSSAEPPSMTQLLRR

SEQ ID NO: 38950 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKSGVSNKDIEKETAKDSAGEPPSMTQLLRR

SEQ ID NO: 38951 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKSGVSNKDIEKETAKDSASEPPSMTQLLRR

SEQ ID NO: 38952 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKSGVSNKDIEKETAKDSAAEPPSMTQLLRR

SEQ ID NO: 38953 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKSGVSNKDIEKETAKDAGGEPPSMTQLLRR

SEQ ID NO: 38954 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKSGVSNKDIEKETAKDAGSEPPSMTQLLRR

SEQ ID NO: 38955 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKSGVSNKDIEKETAKDAGAEPPSMTQLLRR

SEQ ID NO: 38956 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKSGVSNKDIEKETAKDASGEPPSMTQLLRR

SEQ ID NO: 38957 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKSGVSNKDIEKETAKDASSEPPSMTQLLRR

SEQ ID NO: 38958 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKSGVSNKDIEKETAKDASAEPPSMTQLLRR

SEQ ID NO: 38959 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKSGVSNKDIEKETAKDAAGEPPSMTQLLRR

SEQ ID NO: 38960 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKSGVSNKDIEKETAKDAASEPPSMTQLLRR

SEQ ID NO: 38961 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKSGVSNKDIEKETAKDAAAEPPSMTQLLRR

SEQ ID NO: 38962 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKAGVSNKDIEKETAKDGGGEPPSMTQLLRR

SEQ ID NO: 38963 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKAGVSNKDIEKETAKDGGSEPPSMTQLLRR

SEQ ID NO: 38964 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKAGVSNKDIEKETAKDGGAEPPSMTQLLRR

SEQ ID NO: 38965 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKAGVSNKDIEKETAKDGSGEPPSMTQLLRR

SEQ ID NO: 38966 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKAGVSNKDIEKETAKDGSSEPPSMTQLLRR

SEQ ID NO: 38967 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKAGVSNKDIEKETAKDGSAEPPSMTQLLRR

SEQ ID NO: 38968 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKAGVSNKDIEKETAKDGAGEPPSMTQLLRR

SEQ ID NO: 38969 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKAGVSNKDIEKETAKDGASEPPSMTQLLRR

SEQ ID NO: 38970 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKAGVSNKDIEKETAKDGAAEPPSMTQLLRR

SEQ ID NO: 38971 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKAGVSNKDIEKETAKDSGGEPPSMTQLLRR

SEQ ID NO: 38972 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKAGVSNKDIEKETAKDSGSEPPSMTQLLRR

SEQ ID NO: 38973 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKAGVSNKDIEKETAKDSGAEPPSMTQLLRR

SEQ ID NO: 38974 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKAGVSNKDIEKETAKDSSGEPPSMTQLLRR

SEQ ID NO: 38975 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKAGVSNKDIEKETAKDSSSEPPSMTQLLRR

SEQ ID NO: 38976 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKAGVSNKDIEKETAKDSSAEPPSMTQLLRR

SEQ ID NO: 38977 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKAGVSNKDIEKETAKDSAGEPPSMTQLLRR

SEQ ID NO: 38978 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKAGVSNKDIEKETAKDSASEPPSMTQLLRR

SEQ ID NO: 38979 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKAGVSNKDIEKETAKDSAAEPPSMTQLLRR

SEQ ID NO: 38980 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKAGVSNKDIEKETAKDAGGEPPSMTQLLRR

SEQ ID NO: 38981 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKAGVSNKDIEKETAKDAGSEPPSMTQLLRR

SEQ ID NO: 38982 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKAGVSNKDIEKETAKDAGAEPPSMTQLLRR

SEQ ID NO: 38983 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKAGVSNKDIEKETAKDASGEPPSMTQLLRR

SEQ ID NO: 38984 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKAGVSNKDIEKETAKDASSEPPSMTQLLRR

SEQ ID NO: 38985 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKAGVSNKDIEKETAKDASAEPPSMTQLLRR

SEQ ID NO: 38986 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKAGVSNKDIEKETAKDAAGEPPSMTQLLRR

SEQ ID NO: 38987 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKAGVSNKDIEKETAKDAASEPPSMTQLLRR

SEQ ID NO: 38988 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKAGVSNKDIEKETAKDAAAEPPSMTQLLRR

SEQ ID NO: 38989 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKGGVSNKDIEKETAKDGGGEPPSMTQLLRR

SEQ ID NO: 38990 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKGGVSNKDIEKETAKDGGSEPPSMTQLLRR

SEQ ID NO: 38991 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKGGVSNKDIEKETAKDGGAEPPSMTQLLRR

SEQ ID NO: 38992 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKGGVSNKDIEKETAKDGSGEPPSMTQLLRR

SEQ ID NO: 38993 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKGGVSNKDIEKETAKDGSSEPPSMTQLLRR

SEQ ID NO: 38994 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKGGVSNKDIEKETAKDGSAEPPSMTQLLRR

SEQ ID NO: 38995 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKGGVSNKDIEKETAKDGAGEPPSMTQLLRR

SEQ ID NO: 38996 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKGGVSNKDIEKETAKDGASEPPSMTQLLRR

SEQ ID NO: 38997 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKGGVSNKDIEKETAKDGAAEPPSMTQLLRR

SEQ ID NO: 38998 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKGGVSNKDIEKETAKDSGGEPPSMTQLLRR

SEQ ID NO: 38999 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKGGVSNKDIEKETAKDSGSEPPSMTQLLRR

SEQ ID NO: 39000 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKGGVSNKDIEKETAKDSGAEPPSMTQLLRR

SEQ ID NO: 39001 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKGGVSNKDIEKETAKDSSGEPPSMTQLLRR

SEQ ID NO: 39002 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKGGVSNKDIEKETAKDSSSEPPSMTQLLRR

SEQ ID NO: 39003 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKGGVSNKDIEKETAKDSSAEPPSMTQLLRR

SEQ ID NO: 39004 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKGGVSNKDIEKETAKDSAGEPPSMTQLLRR

SEQ ID NO: 39005 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKGGVSNKDIEKETAKDSASEPPSMTQLLRR

SEQ ID NO: 39006 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKGGVSNKDIEKETAKDSAAEPPSMTQLLRR

SEQ ID NO: 39007 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKGGVSNKDIEKETAKDAGGEPPSMTQLLRR

SEQ ID NO: 39008 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKGGVSNKDIEKETAKDAGSEPPSMTQLLRR

SEQ ID NO: 39009 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKGGVSNKDIEKETAKDAGAEPPSMTQLLRR

SEQ ID NO: 39010 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKGGVSNKDIEKETAKDASGEPPSMTQLLRR

SEQ ID NO: 39011 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKGGVSNKDIEKETAKDASSEPPSMTQLLRR

SEQ ID NO: 39012 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKGGVSNKDIEKETAKDASAEPPSMTQLLRR

SEQ ID NO: 39013 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKGGVSNKDIEKETAKDAAGEPPSMTQLLRR

SEQ ID NO: 39014 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKGGVSNKDIEKETAKDAASEPPSMTQLLRR

SEQ ID NO: 39015 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKGGVSNKDIEKETAKDAAAEPPSMTQLLRR

SEQ ID NO: 39016 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKDGVSNKDIEKETAKDGGGEPPSMTQLLRR

SEQ ID NO: 39017 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKDGVSNKDIEKETAKDGGSEPPSMTQLLRR

SEQ ID NO: 39018 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKDGVSNKDIEKETAKDGGAEPPSMTQLLRR

SEQ ID NO: 39019 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKDGVSNKDIEKETAKDGSGEPPSMTQLLRR

SEQ ID NO: 39020 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKDGVSNKDIEKETAKDGSSEPPSMTQLLRR

SEQ ID NO: 39021 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKDGVSNKDIEKETAKDGSAEPPSMTQLLRR

SEQ ID NO: 39022 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKDGVSNKDIEKETAKDGAGEPPSMTQLLRR

SEQ ID NO: 39023 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKDGVSNKDIEKETAKDGASEPPSMTQLLRR

SEQ ID NO: 39024 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKDGVSNKDIEKETAKDGAAEPPSMTQLLRR

SEQ ID NO: 39025 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKDGVSNKDIEKETAKDSGGEPPSMTQLLRR

SEQ ID NO: 39026 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKDGVSNKDIEKETAKDSGSEPPSMTQLLRR

SEQ ID NO: 39027 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKDGVSNKDIEKETAKDSGAEPPSMTQLLRR

SEQ ID NO: 39028 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKDGVSNKDIEKETAKDSSGEPPSMTQLLRR

SEQ ID NO: 39029 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKDGVSNKDIEKETAKDSSSEPPSMTQLLRR

SEQ ID NO: 39030 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKDGVSNKDIEKETAKDSSAEPPSMTQLLRR

SEQ ID NO: 39031 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKDGVSNKDIEKETAKDSAGEPPSMTQLLRR

SEQ ID NO: 39032 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKDGVSNKDIEKETAKDSASEPPSMTQLLRR

SEQ ID NO: 39033 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKDGVSNKDIEKETAKDSAAEPPSMTQLLRR

SEQ ID NO: 39034 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKDGVSNKDIEKETAKDAGGEPPSMTQLLRR

SEQ ID NO: 39035 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKDGVSNKDIEKETAKDAGSEPPSMTQLLRR

SEQ ID NO: 39036 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKDGVSNKDIEKETAKDAGAEPPSMTQLLRR

SEQ ID NO: 39037 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKDGVSNKDIEKETAKDASGEPPSMTQLLRR

SEQ ID NO: 39038 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKDGVSNKDIEKETAKDASSEPPSMTQLLRR

SEQ ID NO: 39039 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKDGVSNKDIEKETAKDASAEPPSMTQLLRR

SEQ ID NO: 39040 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKDGVSNKDIEKETAKDAAGEPPSMTQLLRR

SEQ ID NO: 39041 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKDGVSNKDIEKETAKDAASEPPSMTQLLRR

SEQ ID NO: 39042 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKDGVSNKDIEKETAKDAAAEPPSMTQLLRR

SEQ ID NO: 39043 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKHGVSNKDIEKETAKDGGGEPPSMTQLLRR

SEQ ID NO: 39044 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKHGVSNKDIEKETAKDGGSEPPSMTQLLRR

SEQ ID NO: 39045 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKHGVSNKDIEKETAKDGGAEPPSMTQLLRR

SEQ ID NO: 39046 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKHGVSNKDIEKETAKDGSGEPPSMTQLLRR

SEQ ID NO: 39047 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKHGVSNKDIEKETAKDGSSEPPSMTQLLRR

SEQ ID NO: 39048 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKHGVSNKDIEKETAKDGSAEPPSMTQLLRR

SEQ ID NO: 39049 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKHGVSNKDIEKETAKDGAGEPPSMTQLLRR

SEQ ID NO: 39050 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKHGVSNKDIEKETAKDGASEPPSMTQLLRR

SEQ ID NO: 39051 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKHGVSNKDIEKETAKDGAAEPPSMTQLLRR

SEQ ID NO: 39052 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKHGVSNKDIEKETAKDSGGEPPSMTQLLRR

SEQ ID NO: 39053 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKHGVSNKDIEKETAKDSGSEPPSMTQLLRR

SEQ ID NO: 39054 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKHGVSNKDIEKETAKDSGAEPPSMTQLLRR

SEQ ID NO: 39055 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKHGVSNKDIEKETAKDSSGEPPSMTQLLRR

SEQ ID NO: 39056 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKHGVSNKDIEKETAKDSSSEPPSMTQLLRR

SEQ ID NO: 39057 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKHGVSNKDIEKETAKDSSAEPPSMTQLLRR

SEQ ID NO: 39058 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKHGVSNKDIEKETAKDSAGEPPSMTQLLRR

SEQ ID NO: 39059 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKHGVSNKDIEKETAKDSASEPPSMTQLLRR

SEQ ID NO: 39060 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKHGVSNKDIEKETAKDSAAEPPSMTQLLRR

SEQ ID NO: 39061 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKHGVSNKDIEKETAKDAGGEPPSMTQLLRR

SEQ ID NO: 39062 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKHGVSNKDIEKETAKDAGSEPPSMTQLLRR

SEQ ID NO: 39063 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKHGVSNKDIEKETAKDAGAEPPSMTQLLRR

SEQ ID NO: 39064 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKHGVSNKDIEKETAKDASGEPPSMTQLLRR

SEQ ID NO: 39065 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKHGVSNKDIEKETAKDASSEPPSMTQLLRR

SEQ ID NO: 39066 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKHGVSNKDIEKETAKDASAEPPSMTQLLRR

SEQ ID NO: 39067 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKHGVSNKDIEKETAKDAAGEPPSMTQLLRR

SEQ ID NO: 39068 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKHGVSNKDIEKETAKDAASEPPSMTQLLRR

SEQ ID NO: 39069 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKHGVSNKDIEKETAKDAAAEPPSMTQLLRR

SEQ ID NO: 39070 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKYGVSNKDIEKETAKDGGGEPPSMTQLLRR

SEQ ID NO: 39071 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKYGVSNKDIEKETAKDGGSEPPSMTQLLRR

SEQ ID NO: 39072 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKYGVSNKDIEKETAKDGGAEPPSMTQLLRR

SEQ ID NO: 39073 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKYGVSNKDIEKETAKDGSGEPPSMTQLLRR

SEQ ID NO: 39074 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKYGVSNKDIEKETAKDGSSEPPSMTQLLRR

SEQ ID NO: 39075 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKYGVSNKDIEKETAKDGSAEPPSMTQLLRR

SEQ ID NO: 39076 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKYGVSNKDIEKETAKDGAGEPPSMTQLLRR

SEQ ID NO: 39077 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKYGVSNKDIEKETAKDGASEPPSMTQLLRR

SEQ ID NO: 39078 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKYGVSNKDIEKETAKDGAAEPPSMTQLLRR

SEQ ID NO: 39079 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKYGVSNKDIEKETAKDSGGEPPSMTQLLRR

SEQ ID NO: 39080 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKYGVSNKDIEKETAKDSGSEPPSMTQLLRR

SEQ ID NO: 39081 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKYGVSNKDIEKETAKDSGAEPPSMTQLLRR

SEQ ID NO: 39082 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKYGVSNKDIEKETAKDSSGEPPSMTQLLRR

SEQ ID NO: 39083 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKYGVSNKDIEKETAKDSSSEPPSMTQLLRR

SEQ ID NO: 39084 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKYGVSNKDIEKETAKDSSAEPPSMTQLLRR

SEQ ID NO: 39085 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKYGVSNKDIEKETAKDSAGEPPSMTQLLRR

SEQ ID NO: 39086 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKYGVSNKDIEKETAKDSASEPPSMTQLLRR

SEQ ID NO: 39087 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKYGVSNKDIEKETAKDSAAEPPSMTQLLRR

SEQ ID NO: 39088 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKYGVSNKDIEKETAKDAGGEPPSMTQLLRR

SEQ ID NO: 39089 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKYGVSNKDIEKETAKDAGSEPPSMTQLLRR

SEQ ID NO: 39090 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKYGVSNKDIEKETAKDAGAEPPSMTQLLRR

SEQ ID NO: 39091 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKYGVSNKDIEKETAKDASGEPPSMTQLLRR

SEQ ID NO: 39092 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKYGVSNKDIEKETAKDASSEPPSMTQLLRR

SEQ ID NO: 39093 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKYGVSNKDIEKETAKDASAEPPSMTQLLRR

SEQ ID NO: 39094 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKYGVSNKDIEKETAKDAAGEPPSMTQLLRR

SEQ ID NO: 39095 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKYGVSNKDIEKETAKDAASEPPSMTQLLRR

SEQ ID NO: 39096 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKYGVSNKDIEKETAKDAAAEPPSMTQLLRR

SEQ ID NO: 39097 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKKGVSNKDIEKETAKDGGGEPPSMTQLLRR

SEQ ID NO: 39098 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKKGVSNKDIEKETAKDGGSEPPSMTQLLRR

SEQ ID NO: 39099 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKKGVSNKDIEKETAKDGGAEPPSMTQLLRR

SEQ ID NO: 39100 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKKGVSNKDIEKETAKDGSGEPPSMTQLLRR

SEQ ID NO: 39101 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKKGVSNKDIEKETAKDGSSEPPSMTQLLRR

SEQ ID NO: 39102 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKKGVSNKDIEKETAKDGSAEPPSMTQLLRR

SEQ ID NO: 39103 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKKGVSNKDIEKETAKDGAGEPPSMTQLLRR

SEQ ID NO: 39104 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKKGVSNKDIEKETAKDGASEPPSMTQLLRR

SEQ ID NO: 39105 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKKGVSNKDIEKETAKDGAAEPPSMTQLLRR

SEQ ID NO: 39106 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKKGVSNKDIEKETAKDSGGEPPSMTQLLRR

SEQ ID NO: 39107 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKKGVSNKDIEKETAKDSGSEPPSMTQLLRR

SEQ ID NO: 39108 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKKGVSNKDIEKETAKDSGAEPPSMTQLLRR

SEQ ID NO: 39109 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKKGVSNKDIEKETAKDSSGEPPSMTQLLRR

SEQ ID NO: 39110 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKKGVSNKDIEKETAKDSSSEPPSMTQLLRR

SEQ ID NO: 39111 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKKGVSNKDIEKETAKDSSAEPPSMTQLLRR

SEQ ID NO: 39112 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKKGVSNKDIEKETAKDSAGEPPSMTQLLRR

SEQ ID NO: 39113 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKKGVSNKDIEKETAKDSASEPPSMTQLLRR

SEQ ID NO: 39114 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKKGVSNKDIEKETAKDSAAEPPSMTQLLRR

SEQ ID NO: 39115 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKKGVSNKDIEKETAKDAGGEPPSMTQLLRR

SEQ ID NO: 39116 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKKGVSNKDIEKETAKDAGSEPPSMTQLLRR

SEQ ID NO: 39117 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKKGVSNKDIEKETAKDAGAEPPSMTQLLRR

SEQ ID NO: 39118 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKKGVSNKDIEKETAKDASGEPPSMTQLLRR

SEQ ID NO: 39119 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKKGVSNKDIEKETAKDASSEPPSMTQLLRR

SEQ ID NO: 39120 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKKGVSNKDIEKETAKDASAEPPSMTQLLRR

SEQ ID NO: 39121 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKKGVSNKDIEKETAKDAAGEPPSMTQLLRR

SEQ ID NO: 39122 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKKGVSNKDIEKETAKDAASEPPSMTQLLRR

SEQ ID NO: 39123 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKKGVSNKDIEKETAKDAAAEPPSMTQLLRR

SEQ ID NO: 39124 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKNGVSNKDIEKETAKDGGGEPPSMTQLLRR

SEQ ID NO: 39125 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKNGVSNKDIEKETAKDGGSEPPSMTQLLRR

SEQ ID NO: 39126 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKNGVSNKDIEKETAKDGGAEPPSMTQLLRR

SEQ ID NO: 39127 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKNGVSNKDIEKETAKDGSGEPPSMTQLLRR

SEQ ID NO: 39128 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKNGVSNKDIEKETAKDGSSEPPSMTQLLRR

SEQ ID NO: 39129 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKNGVSNKDIEKETAKDGSAEPPSMTQLLRR

SEQ ID NO: 39130 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKNGVSNKDIEKETAKDGAGEPPSMTQLLRR

SEQ ID NO: 39131 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKNGVSNKDIEKETAKDGASEPPSMTQLLRR

SEQ ID NO: 39132 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKNGVSNKDIEKETAKDGAAEPPSMTQLLRR

SEQ ID NO: 39133 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKNGVSNKDIEKETAKDSGGEPPSMTQLLRR

SEQ ID NO: 39134 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKNGVSNKDIEKETAKDSGSEPPSMTQLLRR

SEQ ID NO: 39135 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKNGVSNKDIEKETAKDSGAEPPSMTQLLRR

SEQ ID NO: 39136 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKNGVSNKDIEKETAKDSSGEPPSMTQLLRR

SEQ ID NO: 39137 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKNGVSNKDIEKETAKDSSSEPPSMTQLLRR

SEQ ID NO: 39138 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKNGVSNKDIEKETAKDSSAEPPSMTQLLRR

SEQ ID NO: 39139 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKNGVSNKDIEKETAKDSAGEPPSMTQLLRR

SEQ ID NO: 39140 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKNGVSNKDIEKETAKDSASEPPSMTQLLRR

SEQ ID NO: 39141 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKNGVSNKDIEKETAKDSAAEPPSMTQLLRR

SEQ ID NO: 39142 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKNGVSNKDIEKETAKDAGGEPPSMTQLLRR

SEQ ID NO: 39143 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKNGVSNKDIEKETAKDAGSEPPSMTQLLRR

SEQ ID NO: 39144 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKNGVSNKDIEKETAKDAGAEPPSMTQLLRR

SEQ ID NO: 39145 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKNGVSNKDIEKETAKDASGEPPSMTQLLRR

SEQ ID NO: 39146 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKNGVSNKDIEKETAKDASSEPPSMTQLLRR

SEQ ID NO: 39147 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKNGVSNKDIEKETAKDASAEPPSMTQLLRR

SEQ ID NO: 39148 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKNGVSNKDIEKETAKDAAGEPPSMTQLLRR

SEQ ID NO: 39149 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKNGVSNKDIEKETAKDAASEPPSMTQLLRR

SEQ ID NO: 39150 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKNGVSNKDIEKETAKDAAAEPPSMTQLLRR

SEQ ID NO: 39151 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKMGVSNKDIEKETAKDGGGEPPSMTQLLRR

SEQ ID NO: 39152 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKMGVSNKDIEKETAKDGGSEPPSMTQLLRR

SEQ ID NO: 39153 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKMGVSNKDIEKETAKDGGAEPPSMTQLLRR

SEQ ID NO: 39154 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKMGVSNKDIEKETAKDGSGEPPSMTQLLRR

SEQ ID NO: 39155 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKMGVSNKDIEKETAKDGSSEPPSMTQLLRR

SEQ ID NO: 39156 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKMGVSNKDIEKETAKDGSAEPPSMTQLLRR

SEQ ID NO: 39157 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKMGVSNKDIEKETAKDGAGEPPSMTQLLRR

SEQ ID NO: 39158 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKMGVSNKDIEKETAKDGASEPPSMTQLLRR

SEQ ID NO: 39159 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKMGVSNKDIEKETAKDGAAEPPSMTQLLRR

SEQ ID NO: 39160 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKMGVSNKDIEKETAKDSGGEPPSMTQLLRR

SEQ ID NO: 39161 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKMGVSNKDIEKETAKDSGSEPPSMTQLLRR

SEQ ID NO: 39162 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKMGVSNKDIEKETAKDSGAEPPSMTQLLRR

SEQ ID NO: 39163 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKMGVSNKDIEKETAKDSSGEPPSMTQLLRR

SEQ ID NO: 39164 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKMGVSNKDIEKETAKDSSSEPPSMTQLLRR

SEQ ID NO: 39165 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKMGVSNKDIEKETAKDSSAEPPSMTQLLRR

SEQ ID NO: 39166 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKMGVSNKDIEKETAKDSAGEPPSMTQLLRR

SEQ ID NO: 39167 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKMGVSNKDIEKETAKDSASEPPSMTQLLRR

SEQ ID NO: 39168 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKMGVSNKDIEKETAKDSAAEPPSMTQLLRR

SEQ ID NO: 39169 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKMGVSNKDIEKETAKDAGGEPPSMTQLLRR

SEQ ID NO: 39170 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKMGVSNKDIEKETAKDAGSEPPSMTQLLRR

SEQ ID NO: 39171 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKMGVSNKDIEKETAKDAGAEPPSMTQLLRR

SEQ ID NO: 39172 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKMGVSNKDIEKETAKDASGEPPSMTQLLRR

SEQ ID NO: 39173 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKMGVSNKDIEKETAKDASSEPPSMTQLLRR

SEQ ID NO: 39174 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKMGVSNKDIEKETAKDASAEPPSMTQLLRR

SEQ ID NO: 39175 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKMGVSNKDIEKETAKDAAGEPPSMTQLLRR

SEQ ID NO: 39176 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKMGVSNKDIEKETAKDAASEPPSMTQLLRR

SEQ ID NO: 39177 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKMGVSNKDIEKETAKDAAAEPPSMTQLLRR

SEQ ID NO: 39178 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKCGVSNKDIEKETAKDGGGEPPSMTQLLRR

SEQ ID NO: 39179 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKCGVSNKDIEKETAKDGGSEPPSMTQLLRR

SEQ ID NO: 39180 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKCGVSNKDIEKETAKDGGAEPPSMTQLLRR

SEQ ID NO: 39181 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKCGVSNKDIEKETAKDGSGEPPSMTQLLRR

SEQ ID NO: 39182 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKCGVSNKDIEKETAKDGSSEPPSMTQLLRR

SEQ ID NO: 39183 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKCGVSNKDIEKETAKDGSAEPPSMTQLLRR

SEQ ID NO: 39184 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKCGVSNKDIEKETAKDGAGEPPSMTQLLRR

SEQ ID NO: 39185 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKCGVSNKDIEKETAKDGASEPPSMTQLLRR

SEQ ID NO: 39186 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKCGVSNKDIEKETAKDGAAEPPSMTQLLRR

SEQ ID NO: 39187 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKCGVSNKDIEKETAKDSGGEPPSMTQLLRR

SEQ ID NO: 39188 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKCGVSNKDIEKETAKDSGSEPPSMTQLLRR

SEQ ID NO: 39189 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKCGVSNKDIEKETAKDSGAEPPSMTQLLRR

SEQ ID NO: 39190 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKCGVSNKDIEKETAKDSSGEPPSMTQLLRR

SEQ ID NO: 39191 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKCGVSNKDIEKETAKDSSSEPPSMTQLLRR

SEQ ID NO: 39192 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKCGVSNKDIEKETAKDSSAEPPSMTQLLRR

SEQ ID NO: 39193 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKCGVSNKDIEKETAKDSAGEPPSMTQLLRR

SEQ ID NO: 39194 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKCGVSNKDIEKETAKDSASEPPSMTQLLRR

SEQ ID NO: 39195 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKCGVSNKDIEKETAKDSAAEPPSMTQLLRR

SEQ ID NO: 39196 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKCGVSNKDIEKETAKDAGGEPPSMTQLLRR

SEQ ID NO: 39197 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKCGVSNKDIEKETAKDAGSEPPSMTQLLRR

SEQ ID NO: 39198 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKCGVSNKDIEKETAKDAGAEPPSMTQLLRR

SEQ ID NO: 39199 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKCGVSNKDIEKETAKDASGEPPSMTQLLRR

SEQ ID NO: 39200 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKCGVSNKDIEKETAKDASSEPPSMTQLLRR

SEQ ID NO: 39201 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKCGVSNKDIEKETAKDASAEPPSMTQLLRR

SEQ ID NO: 39202 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKCGVSNKDIEKETAKDAAGEPPSMTQLLRR

SEQ ID NO: 39203 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKCGVSNKDIEKETAKDAASEPPSMTQLLRR

SEQ ID NO: 39204 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKCGVSNKDIEKETAKDAAAEPPSMTQLLRR

SEQ ID NO: 39205 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKSGVSNKDIEKETAKDGGGEPPSMTQLLRR

SEQ ID NO: 39206 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKSGVSNKDIEKETAKDGGSEPPSMTQLLRR

SEQ ID NO: 39207 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKSGVSNKDIEKETAKDGGAEPPSMTQLLRR

SEQ ID NO: 39208 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKSGVSNKDIEKETAKDGSGEPPSMTQLLRR

SEQ ID NO: 39209 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKSGVSNKDIEKETAKDGSSEPPSMTQLLRR

SEQ ID NO: 39210 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKSGVSNKDIEKETAKDGSAEPPSMTQLLRR

SEQ ID NO: 39211 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKSGVSNKDIEKETAKDGAGEPPSMTQLLRR

SEQ ID NO: 39212 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKSGVSNKDIEKETAKDGASEPPSMTQLLRR

SEQ ID NO: 39213 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKSGVSNKDIEKETAKDGAAEPPSMTQLLRR

SEQ ID NO: 39214 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKSGVSNKDIEKETAKDSGGEPPSMTQLLRR

SEQ ID NO: 39215 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKSGVSNKDIEKETAKDSGSEPPSMTQLLRR

SEQ ID NO: 39216 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKSGVSNKDIEKETAKDSGAEPPSMTQLLRR

SEQ ID NO: 39217 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKSGVSNKDIEKETAKDSSGEPPSMTQLLRR

SEQ ID NO: 39218 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKSGVSNKDIEKETAKDSSSEPPSMTQLLRR

SEQ ID NO: 39219 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKSGVSNKDIEKETAKDSSAEPPSMTQLLRR

SEQ ID NO: 39220 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKSGVSNKDIEKETAKDSAGEPPSMTQLLRR

SEQ ID NO: 39221 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKSGVSNKDIEKETAKDSASEPPSMTQLLRR

SEQ ID NO: 39222 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKSGVSNKDIEKETAKDSAAEPPSMTQLLRR

SEQ ID NO: 39223 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKSGVSNKDIEKETAKDAGGEPPSMTQLLRR

SEQ ID NO: 39224 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKSGVSNKDIEKETAKDAGSEPPSMTQLLRR

SEQ ID NO: 39225 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKSGVSNKDIEKETAKDAGAEPPSMTQLLRR

SEQ ID NO: 39226 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKSGVSNKDIEKETAKDASGEPPSMTQLLRR

SEQ ID NO: 39227 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKSGVSNKDIEKETAKDASSEPPSMTQLLRR

SEQ ID NO: 39228 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKSGVSNKDIEKETAKDASAEPPSMTQLLRR

SEQ ID NO: 39229 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKSGVSNKDIEKETAKDAAGEPPSMTQLLRR

SEQ ID NO: 39230 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKSGVSNKDIEKETAKDAASEPPSMTQLLRR

SEQ ID NO: 39231 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKSGVSNKDIEKETAKDAAAEPPSMTQLLRR

SEQ ID NO: 39232 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKAGVSNKDIEKETAKDGGGEPPSMTQLLRR

SEQ ID NO: 39233 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKAGVSNKDIEKETAKDGGSEPPSMTQLLRR

SEQ ID NO: 39234 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKAGVSNKDIEKETAKDGGAEPPSMTQLLRR

SEQ ID NO: 39235 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKAGVSNKDIEKETAKDGSGEPPSMTQLLRR

SEQ ID NO: 39236 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKAGVSNKDIEKETAKDGSSEPPSMTQLLRR

SEQ ID NO: 39237 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKAGVSNKDIEKETAKDGSAEPPSMTQLLRR

SEQ ID NO: 39238 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKAGVSNKDIEKETAKDGAGEPPSMTQLLRR

SEQ ID NO: 39239 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKAGVSNKDIEKETAKDGASEPPSMTQLLRR

SEQ ID NO: 39240 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKAGVSNKDIEKETAKDGAAEPPSMTQLLRR

SEQ ID NO: 39241 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKAGVSNKDIEKETAKDSGGEPPSMTQLLRR

SEQ ID NO: 39242 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKAGVSNKDIEKETAKDSGSEPPSMTQLLRR

SEQ ID NO: 39243 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKAGVSNKDIEKETAKDSGAEPPSMTQLLRR

SEQ ID NO: 39244 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKAGVSNKDIEKETAKDSSGEPPSMTQLLRR

SEQ ID NO: 39245 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKAGVSNKDIEKETAKDSSSEPPSMTQLLRR

SEQ ID NO: 39246 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKAGVSNKDIEKETAKDSSAEPPSMTQLLRR

SEQ ID NO: 39247 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKAGVSNKDIEKETAKDSAGEPPSMTQLLRR

SEQ ID NO: 39248 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKAGVSNKDIEKETAKDSASEPPSMTQLLRR

SEQ ID NO: 39249 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKAGVSNKDIEKETAKDSAAEPPSMTQLLRR

SEQ ID NO: 39250 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKAGVSNKDIEKETAKDAGGEPPSMTQLLRR

SEQ ID NO: 39251 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKAGVSNKDIEKETAKDAGSEPPSMTQLLRR

SEQ ID NO: 39252 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKAGVSNKDIEKETAKDAGAEPPSMTQLLRR

SEQ ID NO: 39253 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKAGVSNKDIEKETAKDASGEPPSMTQLLRR

SEQ ID NO: 39254 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKAGVSNKDIEKETAKDASSEPPSMTQLLRR

SEQ ID NO: 39255 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKAGVSNKDIEKETAKDASAEPPSMTQLLRR

SEQ ID NO: 39256 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKAGVSNKDIEKETAKDAAGEPPSMTQLLRR

SEQ ID NO: 39257 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKAGVSNKDIEKETAKDAASEPPSMTQLLRR

SEQ ID NO: 39258 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKAGVSNKDIEKETAKDAAAEPPSMTQLLRR

SEQ ID NO: 39259 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKGGVSNKDIEKETAKDGGGEPPSMTQLLRR

SEQ ID NO: 39260 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKGGVSNKDIEKETAKDGGSEPPSMTQLLRR

SEQ ID NO: 39261 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKGGVSNKDIEKETAKDGGAEPPSMTQLLRR

SEQ ID NO: 39262 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKGGVSNKDIEKETAKDGSGEPPSMTQLLRR

SEQ ID NO: 39263 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKGGVSNKDIEKETAKDGSSEPPSMTQLLRR

SEQ ID NO: 39264 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKGGVSNKDIEKETAKDGSAEPPSMTQLLRR

SEQ ID NO: 39265 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKGGVSNKDIEKETAKDGAGEPPSMTQLLRR

SEQ ID NO: 39266 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKGGVSNKDIEKETAKDGASEPPSMTQLLRR

SEQ ID NO: 39267 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKGGVSNKDIEKETAKDGAAEPPSMTQLLRR

SEQ ID NO: 39268 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKGGVSNKDIEKETAKDSGGEPPSMTQLLRR

SEQ ID NO: 39269 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKGGVSNKDIEKETAKDSGSEPPSMTQLLRR

SEQ ID NO: 39270 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKGGVSNKDIEKETAKDSGAEPPSMTQLLRR

SEQ ID NO: 39271 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKGGVSNKDIEKETAKDSSGEPPSMTQLLRR

SEQ ID NO: 39272 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKGGVSNKDIEKETAKDSSSEPPSMTQLLRR

SEQ ID NO: 39273 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKGGVSNKDIEKETAKDSSAEPPSMTQLLRR

SEQ ID NO: 39274 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKGGVSNKDIEKETAKDSAGEPPSMTQLLRR

SEQ ID NO: 39275 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKGGVSNKDIEKETAKDSASEPPSMTQLLRR

SEQ ID NO: 39276 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKGGVSNKDIEKETAKDSAAEPPSMTQLLRR

SEQ ID NO: 39277 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKGGVSNKDIEKETAKDAGGEPPSMTQLLRR

SEQ ID NO: 39278 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKGGVSNKDIEKETAKDAGSEPPSMTQLLRR

SEQ ID NO: 39279 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKGGVSNKDIEKETAKDAGAEPPSMTQLLRR

SEQ ID NO: 39280 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKGGVSNKDIEKETAKDASGEPPSMTQLLRR

SEQ ID NO: 39281 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKGGVSNKDIEKETAKDASSEPPSMTQLLRR

SEQ ID NO: 39282 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKGGVSNKDIEKETAKDASAEPPSMTQLLRR

SEQ ID NO: 39283 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKGGVSNKDIEKETAKDAAGEPPSMTQLLRR

SEQ ID NO: 39284 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKGGVSNKDIEKETAKDAASEPPSMTQLLRR

SEQ ID NO: 39285 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKGGVSNKDIEKETAKDAAAEPPSMTQLLRR

SEQ ID NO: 39286 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKDGVSNKDIEKETAKDGGGEPPSMTQLLRR

SEQ ID NO: 39287 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKDGVSNKDIEKETAKDGGSEPPSMTQLLRR

SEQ ID NO: 39288 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKDGVSNKDIEKETAKDGGAEPPSMTQLLRR

SEQ ID NO: 39289 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKDGVSNKDIEKETAKDGSGEPPSMTQLLRR

SEQ ID NO: 39290 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKDGVSNKDIEKETAKDGSSEPPSMTQLLRR

SEQ ID NO: 39291 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKDGVSNKDIEKETAKDGSAEPPSMTQLLRR

SEQ ID NO: 39292 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKDGVSNKDIEKETAKDGAGEPPSMTQLLRR

SEQ ID NO: 39293 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKDGVSNKDIEKETAKDGASEPPSMTQLLRR

SEQ ID NO: 39294 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKDGVSNKDIEKETAKDGAAEPPSMTQLLRR

SEQ ID NO: 39295 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKDGVSNKDIEKETAKDSGGEPPSMTQLLRR

SEQ ID NO: 39296 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKDGVSNKDIEKETAKDSGSEPPSMTQLLRR

SEQ ID NO: 39297 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKDGVSNKDIEKETAKDSGAEPPSMTQLLRR

SEQ ID NO: 39298 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKDGVSNKDIEKETAKDSSGEPPSMTQLLRR

SEQ ID NO: 39299 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKDGVSNKDIEKETAKDSSSEPPSMTQLLRR

SEQ ID NO: 39300 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKDGVSNKDIEKETAKDSSAEPPSMTQLLRR

SEQ ID NO: 39301 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKDGVSNKDIEKETAKDSAGEPPSMTQLLRR

SEQ ID NO: 39302 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKDGVSNKDIEKETAKDSASEPPSMTQLLRR

SEQ ID NO: 39303 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKDGVSNKDIEKETAKDSAAEPPSMTQLLRR

SEQ ID NO: 39304 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKDGVSNKDIEKETAKDAGGEPPSMTQLLRR

SEQ ID NO: 39305 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKDGVSNKDIEKETAKDAGSEPPSMTQLLRR

SEQ ID NO: 39306 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKDGVSNKDIEKETAKDAGAEPPSMTQLLRR

SEQ ID NO: 39307 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKDGVSNKDIEKETAKDASGEPPSMTQLLRR

SEQ ID NO: 39308 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKDGVSNKDIEKETAKDASSEPPSMTQLLRR

SEQ ID NO: 39309 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKDGVSNKDIEKETAKDASAEPPSMTQLLRR

SEQ ID NO: 39310 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKDGVSNKDIEKETAKDAAGEPPSMTQLLRR

SEQ ID NO: 39311 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKDGVSNKDIEKETAKDAASEPPSMTQLLRR

SEQ ID NO: 39312 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKDGVSNKDIEKETAKDAAAEPPSMTQLLRR

SEQ ID NO: 39313 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKHGVSNKDIEKETAKDGGGEPPSMTQLLRR

SEQ ID NO: 39314 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKHGVSNKDIEKETAKDGGSEPPSMTQLLRR

SEQ ID NO: 39315 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKHGVSNKDIEKETAKDGGAEPPSMTQLLRR

SEQ ID NO: 39316 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKHGVSNKDIEKETAKDGSGEPPSMTQLLRR

SEQ ID NO: 39317 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKHGVSNKDIEKETAKDGSSEPPSMTQLLRR

SEQ ID NO: 39318 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKHGVSNKDIEKETAKDGSAEPPSMTQLLRR

SEQ ID NO: 39319 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKHGVSNKDIEKETAKDGAGEPPSMTQLLRR

SEQ ID NO: 39320 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKHGVSNKDIEKETAKDGASEPPSMTQLLRR

SEQ ID NO: 39321 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKHGVSNKDIEKETAKDGAAEPPSMTQLLRR

SEQ ID NO: 39322 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKHGVSNKDIEKETAKDSGGEPPSMTQLLRR

SEQ ID NO: 39323 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKHGVSNKDIEKETAKDSGSEPPSMTQLLRR

SEQ ID NO: 39324 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKHGVSNKDIEKETAKDSGAEPPSMTQLLRR

SEQ ID NO: 39325 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKHGVSNKDIEKETAKDSSGEPPSMTQLLRR

SEQ ID NO: 39326 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKHGVSNKDIEKETAKDSSSEPPSMTQLLRR

SEQ ID NO: 39327 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKHGVSNKDIEKETAKDSSAEPPSMTQLLRR

SEQ ID NO: 39328 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKHGVSNKDIEKETAKDSAGEPPSMTQLLRR

SEQ ID NO: 39329 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKHGVSNKDIEKETAKDSASEPPSMTQLLRR

SEQ ID NO: 39330 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKHGVSNKDIEKETAKDSAAEPPSMTQLLRR

SEQ ID NO: 39331 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKHGVSNKDIEKETAKDAGGEPPSMTQLLRR

SEQ ID NO: 39332 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKHGVSNKDIEKETAKDAGSEPPSMTQLLRR

SEQ ID NO: 39333 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKHGVSNKDIEKETAKDAGAEPPSMTQLLRR

SEQ ID NO: 39334 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKHGVSNKDIEKETAKDASGEPPSMTQLLRR

SEQ ID NO: 39335 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKHGVSNKDIEKETAKDASSEPPSMTQLLRR

SEQ ID NO: 39336 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKHGVSNKDIEKETAKDASAEPPSMTQLLRR

SEQ ID NO: 39337 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKHGVSNKDIEKETAKDAAGEPPSMTQLLRR

SEQ ID NO: 39338 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKHGVSNKDIEKETAKDAASEPPSMTQLLRR

SEQ ID NO: 39339 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKHGVSNKDIEKETAKDAAAEPPSMTQLLRR

SEQ ID NO: 39340 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKYGVSNKDIEKETAKDGGGEPPSMTQLLRR

SEQ ID NO: 39341 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKYGVSNKDIEKETAKDGGSEPPSMTQLLRR

SEQ ID NO: 39342 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKYGVSNKDIEKETAKDGGAEPPSMTQLLRR

SEQ ID NO: 39343 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKYGVSNKDIEKETAKDGSGEPPSMTQLLRR

SEQ ID NO: 39344 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKYGVSNKDIEKETAKDGSSEPPSMTQLLRR

SEQ ID NO: 39345 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKYGVSNKDIEKETAKDGSAEPPSMTQLLRR

SEQ ID NO: 39346 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKYGVSNKDIEKETAKDGAGEPPSMTQLLRR

SEQ ID NO: 39347 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKYGVSNKDIEKETAKDGASEPPSMTQLLRR

SEQ ID NO: 39348 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKYGVSNKDIEKETAKDGAAEPPSMTQLLRR

SEQ ID NO: 39349 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKYGVSNKDIEKETAKDSGGEPPSMTQLLRR

SEQ ID NO: 39350 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKYGVSNKDIEKETAKDSGSEPPSMTQLLRR

SEQ ID NO: 39351 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKYGVSNKDIEKETAKDSGAEPPSMTQLLRR

SEQ ID NO: 39352 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKYGVSNKDIEKETAKDSSGEPPSMTQLLRR

SEQ ID NO: 39353 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKYGVSNKDIEKETAKDSSSEPPSMTQLLRR

SEQ ID NO: 39354 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKYGVSNKDIEKETAKDSSAEPPSMTQLLRR

SEQ ID NO: 39355 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKYGVSNKDIEKETAKDSAGEPPSMTQLLRR

SEQ ID NO: 39356 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKYGVSNKDIEKETAKDSASEPPSMTQLLRR

SEQ ID NO: 39357 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKYGVSNKDIEKETAKDSAAEPPSMTQLLRR

SEQ ID NO: 39358 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKYGVSNKDIEKETAKDAGGEPPSMTQLLRR

SEQ ID NO: 39359 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKYGVSNKDIEKETAKDAGSEPPSMTQLLRR

SEQ ID NO: 39360 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKYGVSNKDIEKETAKDAGAEPPSMTQLLRR

SEQ ID NO: 39361 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKYGVSNKDIEKETAKDASGEPPSMTQLLRR

SEQ ID NO: 39362 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKYGVSNKDIEKETAKDASSEPPSMTQLLRR

SEQ ID NO: 39363 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKYGVSNKDIEKETAKDASAEPPSMTQLLRR

SEQ ID NO: 39364 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKYGVSNKDIEKETAKDAAGEPPSMTQLLRR

SEQ ID NO: 39365 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKYGVSNKDIEKETAKDAASEPPSMTQLLRR

SEQ ID NO: 39366 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKYGVSNKDIEKETAKDAAAEPPSMTQLLRR

SEQ ID NO: 39367 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKKGVSNKDIEKETAKDGGGEPPSMTQLLRR

SEQ ID NO: 39368 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKKGVSNKDIEKETAKDGGSEPPSMTQLLRR

SEQ ID NO: 39369 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKKGVSNKDIEKETAKDGGAEPPSMTQLLRR

SEQ ID NO: 39370 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKKGVSNKDIEKETAKDGSGEPPSMTQLLRR

SEQ ID NO: 39371 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKKGVSNKDIEKETAKDGSSEPPSMTQLLRR

SEQ ID NO: 39372 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKKGVSNKDIEKETAKDGSAEPPSMTQLLRR

SEQ ID NO: 39373 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKKGVSNKDIEKETAKDGAGEPPSMTQLLRR

SEQ ID NO: 39374 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKKGVSNKDIEKETAKDGASEPPSMTQLLRR

SEQ ID NO: 39375 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKKGVSNKDIEKETAKDGAAEPPSMTQLLRR

SEQ ID NO: 39376 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKKGVSNKDIEKETAKDSGGEPPSMTQLLRR

SEQ ID NO: 39377 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKKGVSNKDIEKETAKDSGSEPPSMTQLLRR

SEQ ID NO: 39378 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKKGVSNKDIEKETAKDSGAEPPSMTQLLRR

SEQ ID NO: 39379 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKKGVSNKDIEKETAKDSSGEPPSMTQLLRR

SEQ ID NO: 39380 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKKGVSNKDIEKETAKDSSSEPPSMTQLLRR

SEQ ID NO: 39381 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKKGVSNKDIEKETAKDSSAEPPSMTQLLRR

SEQ ID NO: 39382 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKKGVSNKDIEKETAKDSAGEPPSMTQLLRR

SEQ ID NO: 39383 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKKGVSNKDIEKETAKDSASEPPSMTQLLRR

SEQ ID NO: 39384 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKKGVSNKDIEKETAKDSAAEPPSMTQLLRR

SEQ ID NO: 39385 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKKGVSNKDIEKETAKDAGGEPPSMTQLLRR

SEQ ID NO: 39386 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKKGVSNKDIEKETAKDAGSEPPSMTQLLRR

SEQ ID NO: 39387 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKKGVSNKDIEKETAKDAGAEPPSMTQLLRR

SEQ ID NO: 39388 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKKGVSNKDIEKETAKDASGEPPSMTQLLRR

SEQ ID NO: 39389 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKKGVSNKDIEKETAKDASSEPPSMTQLLRR

SEQ ID NO: 39390 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKKGVSNKDIEKETAKDASAEPPSMTQLLRR

SEQ ID NO: 39391 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKKGVSNKDIEKETAKDAAGEPPSMTQLLRR

SEQ ID NO: 39392 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKKGVSNKDIEKETAKDAASEPPSMTQLLRR

SEQ ID NO: 39393 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKKGVSNKDIEKETAKDAAAEPPSMTQLLRR

SEQ ID NO: 39394 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKNGVSNKDIEKETAKDGGGEPPSMTQLLRR

SEQ ID NO: 39395 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKNGVSNKDIEKETAKDGGSEPPSMTQLLRR

SEQ ID NO: 39396 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKNGVSNKDIEKETAKDGGAEPPSMTQLLRR

SEQ ID NO: 39397 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKNGVSNKDIEKETAKDGSGEPPSMTQLLRR

SEQ ID NO: 39398 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKNGVSNKDIEKETAKDGSSEPPSMTQLLRR

SEQ ID NO: 39399 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKNGVSNKDIEKETAKDGSAEPPSMTQLLRR

SEQ ID NO: 39400 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKNGVSNKDIEKETAKDGAGEPPSMTQLLRR

SEQ ID NO: 39401 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKNGVSNKDIEKETAKDGASEPPSMTQLLRR

SEQ ID NO: 39402 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKNGVSNKDIEKETAKDGAAEPPSMTQLLRR

SEQ ID NO: 39403 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKNGVSNKDIEKETAKDSGGEPPSMTQLLRR

SEQ ID NO: 39404 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKNGVSNKDIEKETAKDSGSEPPSMTQLLRR

SEQ ID NO: 39405 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKNGVSNKDIEKETAKDSGAEPPSMTQLLRR

SEQ ID NO: 39406 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKNGVSNKDIEKETAKDSSGEPPSMTQLLRR

SEQ ID NO: 39407 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKNGVSNKDIEKETAKDSSSEPPSMTQLLRR

SEQ ID NO: 39408 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKNGVSNKDIEKETAKDSSAEPPSMTQLLRR

SEQ ID NO: 39409 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKNGVSNKDIEKETAKDSAGEPPSMTQLLRR

SEQ ID NO: 39410 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKNGVSNKDIEKETAKDSASEPPSMTQLLRR

SEQ ID NO: 39411 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKNGVSNKDIEKETAKDSAAEPPSMTQLLRR

SEQ ID NO: 39412 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKNGVSNKDIEKETAKDAGGEPPSMTQLLRR

SEQ ID NO: 39413 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKNGVSNKDIEKETAKDAGSEPPSMTQLLRR

SEQ ID NO: 39414 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKNGVSNKDIEKETAKDAGAEPPSMTQLLRR

SEQ ID NO: 39415 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKNGVSNKDIEKETAKDASGEPPSMTQLLRR

SEQ ID NO: 39416 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKNGVSNKDIEKETAKDASSEPPSMTQLLRR

SEQ ID NO: 39417 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKNGVSNKDIEKETAKDASAEPPSMTQLLRR

SEQ ID NO: 39418 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKNGVSNKDIEKETAKDAAGEPPSMTQLLRR

SEQ ID NO: 39419 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKNGVSNKDIEKETAKDAASEPPSMTQLLRR

SEQ ID NO: 39420 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKNGVSNKDIEKETAKDAAAEPPSMTQLLRR

SEQ ID NO: 39421 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKMGVSNKDIEKETAKDGGGEPPSMTQLLRR

SEQ ID NO: 39422 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKMGVSNKDIEKETAKDGGSEPPSMTQLLRR

SEQ ID NO: 39423 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKMGVSNKDIEKETAKDGGAEPPSMTQLLRR

SEQ ID NO: 39424 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKMGVSNKDIEKETAKDGSGEPPSMTQLLRR

SEQ ID NO: 39425 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKMGVSNKDIEKETAKDGSSEPPSMTQLLRR

SEQ ID NO: 39426 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKMGVSNKDIEKETAKDGSAEPPSMTQLLRR

SEQ ID NO: 39427 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKMGVSNKDIEKETAKDGAGEPPSMTQLLRR

SEQ ID NO: 39428 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKMGVSNKDIEKETAKDGASEPPSMTQLLRR

SEQ ID NO: 39429 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKMGVSNKDIEKETAKDGAAEPPSMTQLLRR

SEQ ID NO: 39430 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKMGVSNKDIEKETAKDSGGEPPSMTQLLRR

SEQ ID NO: 39431 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKMGVSNKDIEKETAKDSGSEPPSMTQLLRR

SEQ ID NO: 39432 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKMGVSNKDIEKETAKDSGAEPPSMTQLLRR

SEQ ID NO: 39433 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKMGVSNKDIEKETAKDSSGEPPSMTQLLRR

SEQ ID NO: 39434 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKMGVSNKDIEKETAKDSSSEPPSMTQLLRR

SEQ ID NO: 39435 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKMGVSNKDIEKETAKDSSAEPPSMTQLLRR

SEQ ID NO: 39436 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKMGVSNKDIEKETAKDSAGEPPSMTQLLRR

SEQ ID NO: 39437 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKMGVSNKDIEKETAKDSASEPPSMTQLLRR

SEQ ID NO: 39438 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKMGVSNKDIEKETAKDSAAEPPSMTQLLRR

SEQ ID NO: 39439 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKMGVSNKDIEKETAKDAGGEPPSMTQLLRR

SEQ ID NO: 39440 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKMGVSNKDIEKETAKDAGSEPPSMTQLLRR

SEQ ID NO: 39441 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKMGVSNKDIEKETAKDAGAEPPSMTQLLRR

SEQ ID NO: 39442 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKMGVSNKDIEKETAKDASGEPPSMTQLLRR

SEQ ID NO: 39443 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKMGVSNKDIEKETAKDASSEPPSMTQLLRR

SEQ ID NO: 39444 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKMGVSNKDIEKETAKDASAEPPSMTQLLRR

SEQ ID NO: 39445 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKMGVSNKDIEKETAKDAAGEPPSMTQLLRR

SEQ ID NO: 39446 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKMGVSNKDIEKETAKDAASEPPSMTQLLRR

SEQ ID NO: 39447 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKMGVSNKDIEKETAKDAAAEPPSMTQLLRR

SEQ ID NO: 39448 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKCGVSNKDIEKETAKDGGGEPPSMTQLLRR

SEQ ID NO: 39449 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKCGVSNKDIEKETAKDGGSEPPSMTQLLRR

SEQ ID NO: 39450 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKCGVSNKDIEKETAKDGGAEPPSMTQLLRR

SEQ ID NO: 39451 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKCGVSNKDIEKETAKDGSGEPPSMTQLLRR

SEQ ID NO: 39452 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKCGVSNKDIEKETAKDGSSEPPSMTQLLRR

SEQ ID NO: 39453 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKCGVSNKDIEKETAKDGSAEPPSMTQLLRR

SEQ ID NO: 39454 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKCGVSNKDIEKETAKDGAGEPPSMTQLLRR

SEQ ID NO: 39455 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKCGVSNKDIEKETAKDGASEPPSMTQLLRR

SEQ ID NO: 39456 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKCGVSNKDIEKETAKDGAAEPPSMTQLLRR

SEQ ID NO: 39457 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKCGVSNKDIEKETAKDSGGEPPSMTQLLRR

SEQ ID NO: 39458 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKCGVSNKDIEKETAKDSGSEPPSMTQLLRR

SEQ ID NO: 39459 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKCGVSNKDIEKETAKDSGAEPPSMTQLLRR

SEQ ID NO: 39460 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKCGVSNKDIEKETAKDSSGEPPSMTQLLRR

SEQ ID NO: 39461 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKCGVSNKDIEKETAKDSSSEPPSMTQLLRR

SEQ ID NO: 39462 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKCGVSNKDIEKETAKDSSAEPPSMTQLLRR

SEQ ID NO: 39463 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKCGVSNKDIEKETAKDSAGEPPSMTQLLRR

SEQ ID NO: 39464 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKCGVSNKDIEKETAKDSASEPPSMTQLLRR

SEQ ID NO: 39465 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKCGVSNKDIEKETAKDSAAEPPSMTQLLRR

SEQ ID NO: 39466 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKCGVSNKDIEKETAKDAGGEPPSMTQLLRR

SEQ ID NO: 39467 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKCGVSNKDIEKETAKDAGSEPPSMTQLLRR

SEQ ID NO: 39468 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKCGVSNKDIEKETAKDAGAEPPSMTQLLRR

SEQ ID NO: 39469 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKCGVSNKDIEKETAKDASGEPPSMTQLLRR

SEQ ID NO: 39470 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKCGVSNKDIEKETAKDASSEPPSMTQLLRR

SEQ ID NO: 39471 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKCGVSNKDIEKETAKDASAEPPSMTQLLRR

SEQ ID NO: 39472 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKCGVSNKDIEKETAKDAAGEPPSMTQLLRR

SEQ ID NO: 39473 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKCGVSNKDIEKETAKDAASEPPSMTQLLRR

SEQ ID NO: 39474 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKCGVSNKDIEKETAKDAAAEPPSMTQLLRR

SEQ ID NO: 39475 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKSGVSNKDIEKETAKDGGGEPPSMTQLLRR

SEQ ID NO: 39476 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKSGVSNKDIEKETAKDGGSEPPSMTQLLRR

SEQ ID NO: 39477 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKSGVSNKDIEKETAKDGGAEPPSMTQLLRR

SEQ ID NO: 39478 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKSGVSNKDIEKETAKDGSGEPPSMTQLLRR

SEQ ID NO: 39479 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKSGVSNKDIEKETAKDGSSEPPSMTQLLRR

SEQ ID NO: 39480 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKSGVSNKDIEKETAKDGSAEPPSMTQLLRR

SEQ ID NO: 39481 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKSGVSNKDIEKETAKDGAGEPPSMTQLLRR

SEQ ID NO: 39482 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKSGVSNKDIEKETAKDGASEPPSMTQLLRR

SEQ ID NO: 39483 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKSGVSNKDIEKETAKDGAAEPPSMTQLLRR

SEQ ID NO: 39484 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKSGVSNKDIEKETAKDSGGEPPSMTQLLRR

SEQ ID NO: 39485 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKSGVSNKDIEKETAKDSGSEPPSMTQLLRR

SEQ ID NO: 39486 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKSGVSNKDIEKETAKDSGAEPPSMTQLLRR

SEQ ID NO: 39487 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKSGVSNKDIEKETAKDSSGEPPSMTQLLRR

SEQ ID NO: 39488 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKSGVSNKDIEKETAKDSSSEPPSMTQLLRR

SEQ ID NO: 39489 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKSGVSNKDIEKETAKDSSAEPPSMTQLLRR

SEQ ID NO: 39490 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKSGVSNKDIEKETAKDSAGEPPSMTQLLRR

SEQ ID NO: 39491 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKSGVSNKDIEKETAKDSASEPPSMTQLLRR

SEQ ID NO: 39492 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKSGVSNKDIEKETAKDSAAEPPSMTQLLRR

SEQ ID NO: 39493 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKSGVSNKDIEKETAKDAGGEPPSMTQLLRR

SEQ ID NO: 39494 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKSGVSNKDIEKETAKDAGSEPPSMTQLLRR

SEQ ID NO: 39495 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKSGVSNKDIEKETAKDAGAEPPSMTQLLRR

SEQ ID NO: 39496 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKSGVSNKDIEKETAKDASGEPPSMTQLLRR

SEQ ID NO: 39497 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKSGVSNKDIEKETAKDASSEPPSMTQLLRR

SEQ ID NO: 39498 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKSGVSNKDIEKETAKDASAEPPSMTQLLRR

SEQ ID NO: 39499 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKSGVSNKDIEKETAKDAAGEPPSMTQLLRR

SEQ ID NO: 39500 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKSGVSNKDIEKETAKDAASEPPSMTQLLRR

SEQ ID NO: 39501 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKSGVSNKDIEKETAKDAAAEPPSMTQLLRR

SEQ ID NO: 39502 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKAGVSNKDIEKETAKDGGGEPPSMTQLLRR

SEQ ID NO: 39503 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKAGVSNKDIEKETAKDGGSEPPSMTQLLRR

SEQ ID NO: 39504 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKAGVSNKDIEKETAKDGGAEPPSMTQLLRR

SEQ ID NO: 39505 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKAGVSNKDIEKETAKDGSGEPPSMTQLLRR

SEQ ID NO: 39506 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKAGVSNKDIEKETAKDGSSEPPSMTQLLRR

SEQ ID NO: 39507 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKAGVSNKDIEKETAKDGSAEPPSMTQLLRR

SEQ ID NO: 39508 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKAGVSNKDIEKETAKDGAGEPPSMTQLLRR

SEQ ID NO: 39509 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKAGVSNKDIEKETAKDGASEPPSMTQLLRR

SEQ ID NO: 39510 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKAGVSNKDIEKETAKDGAAEPPSMTQLLRR

SEQ ID NO: 39511 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKAGVSNKDIEKETAKDSGGEPPSMTQLLRR

SEQ ID NO: 39512 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKAGVSNKDIEKETAKDSGSEPPSMTQLLRR

SEQ ID NO: 39513 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKAGVSNKDIEKETAKDSGAEPPSMTQLLRR

SEQ ID NO: 39514 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKAGVSNKDIEKETAKDSSGEPPSMTQLLRR

SEQ ID NO: 39515 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKAGVSNKDIEKETAKDSSSEPPSMTQLLRR

SEQ ID NO: 39516 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKAGVSNKDIEKETAKDSSAEPPSMTQLLRR

SEQ ID NO: 39517 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKAGVSNKDIEKETAKDSAGEPPSMTQLLRR

SEQ ID NO: 39518 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKAGVSNKDIEKETAKDSASEPPSMTQLLRR

SEQ ID NO: 39519 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKAGVSNKDIEKETAKDSAAEPPSMTQLLRR

SEQ ID NO: 39520 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKAGVSNKDIEKETAKDAGGEPPSMTQLLRR

SEQ ID NO: 39521 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKAGVSNKDIEKETAKDAGSEPPSMTQLLRR

SEQ ID NO: 39522 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKAGVSNKDIEKETAKDAGAEPPSMTQLLRR

SEQ ID NO: 39523 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKAGVSNKDIEKETAKDASGEPPSMTQLLRR

SEQ ID NO: 39524 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKAGVSNKDIEKETAKDASSEPPSMTQLLRR

SEQ ID NO: 39525 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKAGVSNKDIEKETAKDASAEPPSMTQLLRR

SEQ ID NO: 39526 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKAGVSNKDIEKETAKDAAGEPPSMTQLLRR

SEQ ID NO: 39527 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKAGVSNKDIEKETAKDAASEPPSMTQLLRR

SEQ ID NO: 39528 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKAGVSNKDIEKETAKDAAAEPPSMTQLLRR

SEQ ID NO: 39529 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKGGVSNKDIEKETAKDGGGEPPSMTQLLRR

SEQ ID NO: 39530 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKGGVSNKDIEKETAKDGGSEPPSMTQLLRR

SEQ ID NO: 39531 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKGGVSNKDIEKETAKDGGAEPPSMTQLLRR

SEQ ID NO: 39532 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKGGVSNKDIEKETAKDGSGEPPSMTQLLRR

SEQ ID NO: 39533 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKGGVSNKDIEKETAKDGSSEPPSMTQLLRR

SEQ ID NO: 39534 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKGGVSNKDIEKETAKDGSAEPPSMTQLLRR

SEQ ID NO: 39535 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKGGVSNKDIEKETAKDGAGEPPSMTQLLRR

SEQ ID NO: 39536 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKGGVSNKDIEKETAKDGASEPPSMTQLLRR

SEQ ID NO: 39537 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKGGVSNKDIEKETAKDGAAEPPSMTQLLRR

SEQ ID NO: 39538 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKGGVSNKDIEKETAKDSGGEPPSMTQLLRR

SEQ ID NO: 39539 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKGGVSNKDIEKETAKDSGSEPPSMTQLLRR

SEQ ID NO: 39540 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKGGVSNKDIEKETAKDSGAEPPSMTQLLRR

SEQ ID NO: 39541 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKGGVSNKDIEKETAKDSSGEPPSMTQLLRR

SEQ ID NO: 39542 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKGGVSNKDIEKETAKDSSSEPPSMTQLLRR

SEQ ID NO: 39543 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKGGVSNKDIEKETAKDSSAEPPSMTQLLRR

SEQ ID NO: 39544 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKGGVSNKDIEKETAKDSAGEPPSMTQLLRR

SEQ ID NO: 39545 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKGGVSNKDIEKETAKDSASEPPSMTQLLRR

SEQ ID NO: 39546 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKGGVSNKDIEKETAKDSAAEPPSMTQLLRR

SEQ ID NO: 39547 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKGGVSNKDIEKETAKDAGGEPPSMTQLLRR

SEQ ID NO: 39548 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKGGVSNKDIEKETAKDAGSEPPSMTQLLRR

SEQ ID NO: 39549 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKGGVSNKDIEKETAKDAGAEPPSMTQLLRR

SEQ ID NO: 39550 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKGGVSNKDIEKETAKDASGEPPSMTQLLRR

SEQ ID NO: 39551 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKGGVSNKDIEKETAKDASSEPPSMTQLLRR

SEQ ID NO: 39552 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKGGVSNKDIEKETAKDASAEPPSMTQLLRR

SEQ ID NO: 39553 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKGGVSNKDIEKETAKDAAGEPPSMTQLLRR

SEQ ID NO: 39554 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKGGVSNKDIEKETAKDAASEPPSMTQLLRR

SEQ ID NO: 39555 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKGGVSNKDIEKETAKDAAAEPPSMTQLLRR

SEQ ID NO: 39556 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKDGVSNKDIEKETAKDGGGEPPSMTQLLRR

SEQ ID NO: 39557 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKDGVSNKDIEKETAKDGGSEPPSMTQLLRR

SEQ ID NO: 39558 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKDGVSNKDIEKETAKDGGAEPPSMTQLLRR

SEQ ID NO: 39559 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKDGVSNKDIEKETAKDGSGEPPSMTQLLRR

SEQ ID NO: 39560 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKDGVSNKDIEKETAKDGSSEPPSMTQLLRR

SEQ ID NO: 39561 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKDGVSNKDIEKETAKDGSAEPPSMTQLLRR

SEQ ID NO: 39562 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKDGVSNKDIEKETAKDGAGEPPSMTQLLRR

SEQ ID NO: 39563 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKDGVSNKDIEKETAKDGASEPPSMTQLLRR

SEQ ID NO: 39564 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKDGVSNKDIEKETAKDGAAEPPSMTQLLRR

SEQ ID NO: 39565 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKDGVSNKDIEKETAKDSGGEPPSMTQLLRR

SEQ ID NO: 39566 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKDGVSNKDIEKETAKDSGSEPPSMTQLLRR

SEQ ID NO: 39567 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKDGVSNKDIEKETAKDSGAEPPSMTQLLRR

SEQ ID NO: 39568 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKDGVSNKDIEKETAKDSSGEPPSMTQLLRR

SEQ ID NO: 39569 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKDGVSNKDIEKETAKDSSSEPPSMTQLLRR

SEQ ID NO: 39570 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKDGVSNKDIEKETAKDSSAEPPSMTQLLRR

SEQ ID NO: 39571 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKDGVSNKDIEKETAKDSAGEPPSMTQLLRR

SEQ ID NO: 39572 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKDGVSNKDIEKETAKDSASEPPSMTQLLRR

SEQ ID NO: 39573 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKDGVSNKDIEKETAKDSAAEPPSMTQLLRR

SEQ ID NO: 39574 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKDGVSNKDIEKETAKDAGGEPPSMTQLLRR

SEQ ID NO: 39575 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKDGVSNKDIEKETAKDAGSEPPSMTQLLRR

SEQ ID NO: 39576 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKDGVSNKDIEKETAKDAGAEPPSMTQLLRR

SEQ ID NO: 39577 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKDGVSNKDIEKETAKDASGEPPSMTQLLRR

SEQ ID NO: 39578 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKDGVSNKDIEKETAKDASSEPPSMTQLLRR

SEQ ID NO: 39579 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKDGVSNKDIEKETAKDASAEPPSMTQLLRR

SEQ ID NO: 39580 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKDGVSNKDIEKETAKDAAGEPPSMTQLLRR

SEQ ID NO: 39581 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKDGVSNKDIEKETAKDAASEPPSMTQLLRR

SEQ ID NO: 39582 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKDGVSNKDIEKETAKDAAAEPPSMTQLLRR

SEQ ID NO: 39583 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKHGVSNKDIEKETAKDGGGEPPSMTQLLRR

SEQ ID NO: 39584 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKHGVSNKDIEKETAKDGGSEPPSMTQLLRR

SEQ ID NO: 39585 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKHGVSNKDIEKETAKDGGAEPPSMTQLLRR

SEQ ID NO: 39586 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKHGVSNKDIEKETAKDGSGEPPSMTQLLRR

SEQ ID NO: 39587 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKHGVSNKDIEKETAKDGSSEPPSMTQLLRR

SEQ ID NO: 39588 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKHGVSNKDIEKETAKDGSAEPPSMTQLLRR

SEQ ID NO: 39589 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKHGVSNKDIEKETAKDGAGEPPSMTQLLRR

SEQ ID NO: 39590 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKHGVSNKDIEKETAKDGASEPPSMTQLLRR

SEQ ID NO: 39591 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKHGVSNKDIEKETAKDGAAEPPSMTQLLRR

SEQ ID NO: 39592 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKHGVSNKDIEKETAKDSGGEPPSMTQLLRR

SEQ ID NO: 39593 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKHGVSNKDIEKETAKDSGSEPPSMTQLLRR

SEQ ID NO: 39594 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKHGVSNKDIEKETAKDSGAEPPSMTQLLRR

SEQ ID NO: 39595 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKHGVSNKDIEKETAKDSSGEPPSMTQLLRR

SEQ ID NO: 39596 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKHGVSNKDIEKETAKDSSSEPPSMTQLLRR

SEQ ID NO: 39597 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKHGVSNKDIEKETAKDSSAEPPSMTQLLRR

SEQ ID NO: 39598 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKHGVSNKDIEKETAKDSAGEPPSMTQLLRR

SEQ ID NO: 39599 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKHGVSNKDIEKETAKDSASEPPSMTQLLRR

SEQ ID NO: 39600 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKHGVSNKDIEKETAKDSAAEPPSMTQLLRR

SEQ ID NO: 39601 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKHGVSNKDIEKETAKDAGGEPPSMTQLLRR

SEQ ID NO: 39602 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKHGVSNKDIEKETAKDAGSEPPSMTQLLRR

SEQ ID NO: 39603 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKHGVSNKDIEKETAKDAGAEPPSMTQLLRR

SEQ ID NO: 39604 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKHGVSNKDIEKETAKDASGEPPSMTQLLRR

SEQ ID NO: 39605 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKHGVSNKDIEKETAKDASSEPPSMTQLLRR

SEQ ID NO: 39606 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKHGVSNKDIEKETAKDASAEPPSMTQLLRR

SEQ ID NO: 39607 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKHGVSNKDIEKETAKDAAGEPPSMTQLLRR

SEQ ID NO: 39608 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKHGVSNKDIEKETAKDAASEPPSMTQLLRR

SEQ ID NO: 39609 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKHGVSNKDIEKETAKDAAAEPPSMTQLLRR

SEQ ID NO: 39610 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKYGVSNKDIEKETAKDGGGEPPSMTQLLRR

SEQ ID NO: 39611 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKYGVSNKDIEKETAKDGGSEPPSMTQLLRR

SEQ ID NO: 39612 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKYGVSNKDIEKETAKDGGAEPPSMTQLLRR

SEQ ID NO: 39613 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKYGVSNKDIEKETAKDGSGEPPSMTQLLRR

SEQ ID NO: 39614 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKYGVSNKDIEKETAKDGSSEPPSMTQLLRR

SEQ ID NO: 39615 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKYGVSNKDIEKETAKDGSAEPPSMTQLLRR

SEQ ID NO: 39616 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKYGVSNKDIEKETAKDGAGEPPSMTQLLRR

SEQ ID NO: 39617 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKYGVSNKDIEKETAKDGASEPPSMTQLLRR

SEQ ID NO: 39618 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKYGVSNKDIEKETAKDGAAEPPSMTQLLRR

SEQ ID NO: 39619 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKYGVSNKDIEKETAKDSGGEPPSMTQLLRR

SEQ ID NO: 39620 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKYGVSNKDIEKETAKDSGSEPPSMTQLLRR

SEQ ID NO: 39621 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKYGVSNKDIEKETAKDSGAEPPSMTQLLRR

SEQ ID NO: 39622 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKYGVSNKDIEKETAKDSSGEPPSMTQLLRR

SEQ ID NO: 39623 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKYGVSNKDIEKETAKDSSSEPPSMTQLLRR

SEQ ID NO: 39624 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKYGVSNKDIEKETAKDSSAEPPSMTQLLRR

SEQ ID NO: 39625 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKYGVSNKDIEKETAKDSAGEPPSMTQLLRR

SEQ ID NO: 39626 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKYGVSNKDIEKETAKDSASEPPSMTQLLRR

SEQ ID NO: 39627 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKYGVSNKDIEKETAKDSAAEPPSMTQLLRR

SEQ ID NO: 39628 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKYGVSNKDIEKETAKDAGGEPPSMTQLLRR

SEQ ID NO: 39629 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKYGVSNKDIEKETAKDAGSEPPSMTQLLRR

SEQ ID NO: 39630 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKYGVSNKDIEKETAKDAGAEPPSMTQLLRR

SEQ ID NO: 39631 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKYGVSNKDIEKETAKDASGEPPSMTQLLRR

SEQ ID NO: 39632 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKYGVSNKDIEKETAKDASSEPPSMTQLLRR

SEQ ID NO: 39633 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKYGVSNKDIEKETAKDASAEPPSMTQLLRR

SEQ ID NO: 39634 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKYGVSNKDIEKETAKDAAGEPPSMTQLLRR

SEQ ID NO: 39635 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKYGVSNKDIEKETAKDAASEPPSMTQLLRR

SEQ ID NO: 39636 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKYGVSNKDIEKETAKDAAAEPPSMTQLLRR

SEQ ID NO: 39637 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKKGVSNKDIEKETAKDGGGEPPSMTQLLRR

SEQ ID NO: 39638 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKKGVSNKDIEKETAKDGGSEPPSMTQLLRR

SEQ ID NO: 39639 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKKGVSNKDIEKETAKDGGAEPPSMTQLLRR

SEQ ID NO: 39640 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKKGVSNKDIEKETAKDGSGEPPSMTQLLRR

SEQ ID NO: 39641 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKKGVSNKDIEKETAKDGSSEPPSMTQLLRR

SEQ ID NO: 39642 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKKGVSNKDIEKETAKDGSAEPPSMTQLLRR

SEQ ID NO: 39643 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKKGVSNKDIEKETAKDGAGEPPSMTQLLRR

SEQ ID NO: 39644 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKKGVSNKDIEKETAKDGASEPPSMTQLLRR

SEQ ID NO: 39645 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKKGVSNKDIEKETAKDGAAEPPSMTQLLRR

SEQ ID NO: 39646 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKKGVSNKDIEKETAKDSGGEPPSMTQLLRR

SEQ ID NO: 39647 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKKGVSNKDIEKETAKDSGSEPPSMTQLLRR

SEQ ID NO: 39648 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKKGVSNKDIEKETAKDSGAEPPSMTQLLRR

SEQ ID NO: 39649 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKKGVSNKDIEKETAKDSSGEPPSMTQLLRR

SEQ ID NO: 39650 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKKGVSNKDIEKETAKDSSSEPPSMTQLLRR

SEQ ID NO: 39651 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKKGVSNKDIEKETAKDSSAEPPSMTQLLRR

SEQ ID NO: 39652 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKKGVSNKDIEKETAKDSAGEPPSMTQLLRR

SEQ ID NO: 39653 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKKGVSNKDIEKETAKDSASEPPSMTQLLRR

SEQ ID NO: 39654 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKKGVSNKDIEKETAKDSAAEPPSMTQLLRR

SEQ ID NO: 39655 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKKGVSNKDIEKETAKDAGGEPPSMTQLLRR

SEQ ID NO: 39656 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKKGVSNKDIEKETAKDAGSEPPSMTQLLRR

SEQ ID NO: 39657 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKKGVSNKDIEKETAKDAGAEPPSMTQLLRR

SEQ ID NO: 39658 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKKGVSNKDIEKETAKDASGEPPSMTQLLRR

SEQ ID NO: 39659 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKKGVSNKDIEKETAKDASSEPPSMTQLLRR

SEQ ID NO: 39660 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKKGVSNKDIEKETAKDASAEPPSMTQLLRR

SEQ ID NO: 39661 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKKGVSNKDIEKETAKDAAGEPPSMTQLLRR

SEQ ID NO: 39662 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKKGVSNKDIEKETAKDAASEPPSMTQLLRR

SEQ ID NO: 39663 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKKGVSNKDIEKETAKDAAAEPPSMTQLLRR

SEQ ID NO: 39664 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKNGVSNKDIEKETAKDGGGEPPSMTQLLRR

SEQ ID NO: 39665 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKNGVSNKDIEKETAKDGGSEPPSMTQLLRR

SEQ ID NO: 39666 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKNGVSNKDIEKETAKDGGAEPPSMTQLLRR

SEQ ID NO: 39667 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKNGVSNKDIEKETAKDGSGEPPSMTQLLRR

SEQ ID NO: 39668 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKNGVSNKDIEKETAKDGSSEPPSMTQLLRR

SEQ ID NO: 39669 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKNGVSNKDIEKETAKDGSAEPPSMTQLLRR

SEQ ID NO: 39670 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKNGVSNKDIEKETAKDGAGEPPSMTQLLRR

SEQ ID NO: 39671 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKNGVSNKDIEKETAKDGASEPPSMTQLLRR

SEQ ID NO: 39672 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKNGVSNKDIEKETAKDGAAEPPSMTQLLRR

SEQ ID NO: 39673 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKNGVSNKDIEKETAKDSGGEPPSMTQLLRR

SEQ ID NO: 39674 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKNGVSNKDIEKETAKDSGSEPPSMTQLLRR

SEQ ID NO: 39675 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKNGVSNKDIEKETAKDSGAEPPSMTQLLRR

SEQ ID NO: 39676 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKNGVSNKDIEKETAKDSSGEPPSMTQLLRR

SEQ ID NO: 39677 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKNGVSNKDIEKETAKDSSSEPPSMTQLLRR

SEQ ID NO: 39678 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKNGVSNKDIEKETAKDSSAEPPSMTQLLRR

SEQ ID NO: 39679 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKNGVSNKDIEKETAKDSAGEPPSMTQLLRR

SEQ ID NO: 39680 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKNGVSNKDIEKETAKDSASEPPSMTQLLRR

SEQ ID NO: 39681 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKNGVSNKDIEKETAKDSAAEPPSMTQLLRR

SEQ ID NO: 39682 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKNGVSNKDIEKETAKDAGGEPPSMTQLLRR

SEQ ID NO: 39683 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKNGVSNKDIEKETAKDAGSEPPSMTQLLRR

SEQ ID NO: 39684 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKNGVSNKDIEKETAKDAGAEPPSMTQLLRR

SEQ ID NO: 39685 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKNGVSNKDIEKETAKDASGEPPSMTQLLRR

SEQ ID NO: 39686 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKNGVSNKDIEKETAKDASSEPPSMTQLLRR

SEQ ID NO: 39687 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKNGVSNKDIEKETAKDASAEPPSMTQLLRR

SEQ ID NO: 39688 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKNGVSNKDIEKETAKDAAGEPPSMTQLLRR

SEQ ID NO: 39689 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKNGVSNKDIEKETAKDAASEPPSMTQLLRR

SEQ ID NO: 39690 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKNGVSNKDIEKETAKDAAAEPPSMTQLLRR

SEQ ID NO: 39691 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKMGVSNKDIEKETAKDGGGEPPSMTQLLRR

SEQ ID NO: 39692 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKMGVSNKDIEKETAKDGGSEPPSMTQLLRR

SEQ ID NO: 39693 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKMGVSNKDIEKETAKDGGAEPPSMTQLLRR

SEQ ID NO: 39694 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKMGVSNKDIEKETAKDGSGEPPSMTQLLRR

SEQ ID NO: 39695 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKMGVSNKDIEKETAKDGSSEPPSMTQLLRR

SEQ ID NO: 39696 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKMGVSNKDIEKETAKDGSAEPPSMTQLLRR

SEQ ID NO: 39697 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKMGVSNKDIEKETAKDGAGEPPSMTQLLRR

SEQ ID NO: 39698 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKMGVSNKDIEKETAKDGASEPPSMTQLLRR

SEQ ID NO: 39699 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKMGVSNKDIEKETAKDGAAEPPSMTQLLRR

SEQ ID NO: 39700 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKMGVSNKDIEKETAKDSGGEPPSMTQLLRR

SEQ ID NO: 39701 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKMGVSNKDIEKETAKDSGSEPPSMTQLLRR

SEQ ID NO: 39702 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKMGVSNKDIEKETAKDSGAEPPSMTQLLRR

SEQ ID NO: 39703 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKMGVSNKDIEKETAKDSSGEPPSMTQLLRR

SEQ ID NO: 39704 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKMGVSNKDIEKETAKDSSSEPPSMTQLLRR

SEQ ID NO: 39705 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKMGVSNKDIEKETAKDSSAEPPSMTQLLRR

SEQ ID NO: 39706 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKMGVSNKDIEKETAKDSAGEPPSMTQLLRR

SEQ ID NO: 39707 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKMGVSNKDIEKETAKDSASEPPSMTQLLRR

SEQ ID NO: 39708 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKMGVSNKDIEKETAKDSAAEPPSMTQLLRR

SEQ ID NO: 39709 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKMGVSNKDIEKETAKDAGGEPPSMTQLLRR

SEQ ID NO: 39710 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKMGVSNKDIEKETAKDAGSEPPSMTQLLRR

SEQ ID NO: 39711 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKMGVSNKDIEKETAKDAGAEPPSMTQLLRR

SEQ ID NO: 39712 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKMGVSNKDIEKETAKDASGEPPSMTQLLRR

SEQ ID NO: 39713 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKMGVSNKDIEKETAKDASSEPPSMTQLLRR

SEQ ID NO: 39714 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKMGVSNKDIEKETAKDASAEPPSMTQLLRR

SEQ ID NO: 39715 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKMGVSNKDIEKETAKDAAGEPPSMTQLLRR

SEQ ID NO: 39716 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKMGVSNKDIEKETAKDAASEPPSMTQLLRR

SEQ ID NO: 39717 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKMGVSNKDIEKETAKDAAAEPPSMTQLLRR

SEQ ID NO: 39718 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKCGVSNKDIEKETAKDGGGEPPSMTQLLRR

SEQ ID NO: 39719 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKCGVSNKDIEKETAKDGGSEPPSMTQLLRR

SEQ ID NO: 39720 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKCGVSNKDIEKETAKDGGAEPPSMTQLLRR

SEQ ID NO: 39721 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKCGVSNKDIEKETAKDGSGEPPSMTQLLRR

SEQ ID NO: 39722 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKCGVSNKDIEKETAKDGSSEPPSMTQLLRR

SEQ ID NO: 39723 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKCGVSNKDIEKETAKDGSAEPPSMTQLLRR

SEQ ID NO: 39724 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKCGVSNKDIEKETAKDGAGEPPSMTQLLRR

SEQ ID NO: 39725 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKCGVSNKDIEKETAKDGASEPPSMTQLLRR

SEQ ID NO: 39726 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKCGVSNKDIEKETAKDGAAEPPSMTQLLRR

SEQ ID NO: 39727 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKCGVSNKDIEKETAKDSGGEPPSMTQLLRR

SEQ ID NO: 39728 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKCGVSNKDIEKETAKDSGSEPPSMTQLLRR

SEQ ID NO: 39729 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKCGVSNKDIEKETAKDSGAEPPSMTQLLRR

SEQ ID NO: 39730 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKCGVSNKDIEKETAKDSSGEPPSMTQLLRR

SEQ ID NO: 39731 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKCGVSNKDIEKETAKDSSSEPPSMTQLLRR

SEQ ID NO: 39732 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKCGVSNKDIEKETAKDSSAEPPSMTQLLRR

SEQ ID NO: 39733 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKCGVSNKDIEKETAKDSAGEPPSMTQLLRR

SEQ ID NO: 39734 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKCGVSNKDIEKETAKDSASEPPSMTQLLRR

SEQ ID NO: 39735 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKCGVSNKDIEKETAKDSAAEPPSMTQLLRR

SEQ ID NO: 39736 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKCGVSNKDIEKETAKDAGGEPPSMTQLLRR

SEQ ID NO: 39737 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKCGVSNKDIEKETAKDAGSEPPSMTQLLRR

SEQ ID NO: 39738 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKCGVSNKDIEKETAKDAGAEPPSMTQLLRR

SEQ ID NO: 39739 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKCGVSNKDIEKETAKDASGEPPSMTQLLRR

SEQ ID NO: 39740 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKCGVSNKDIEKETAKDASSEPPSMTQLLRR

SEQ ID NO: 39741 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKCGVSNKDIEKETAKDASAEPPSMTQLLRR

SEQ ID NO: 39742 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKCGVSNKDIEKETAKDAAGEPPSMTQLLRR

SEQ ID NO: 39743 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKCGVSNKDIEKETAKDAASEPPSMTQLLRR

SEQ ID NO: 39744 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKCGVSNKDIEKETAKDAAAEPPSMTQLLRR

SEQ ID NO: 39745 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKSGVSNKDIEKETAKDGGGEPPSMTQLLRR

SEQ ID NO: 39746 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKSGVSNKDIEKETAKDGGSEPPSMTQLLRR

SEQ ID NO: 39747 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKSGVSNKDIEKETAKDGGAEPPSMTQLLRR

SEQ ID NO: 39748 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKSGVSNKDIEKETAKDGSGEPPSMTQLLRR

SEQ ID NO: 39749 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKSGVSNKDIEKETAKDGSSEPPSMTQLLRR

SEQ ID NO: 39750 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKSGVSNKDIEKETAKDGSAEPPSMTQLLRR

SEQ ID NO: 39751 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKSGVSNKDIEKETAKDGAGEPPSMTQLLRR

SEQ ID NO: 39752 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKSGVSNKDIEKETAKDGASEPPSMTQLLRR

SEQ ID NO: 39753 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKSGVSNKDIEKETAKDGAAEPPSMTQLLRR

SEQ ID NO: 39754 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKSGVSNKDIEKETAKDSGGEPPSMTQLLRR

SEQ ID NO: 39755 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKSGVSNKDIEKETAKDSGSEPPSMTQLLRR

SEQ ID NO: 39756 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKSGVSNKDIEKETAKDSGAEPPSMTQLLRR

SEQ ID NO: 39757 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKSGVSNKDIEKETAKDSSGEPPSMTQLLRR

SEQ ID NO: 39758 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKSGVSNKDIEKETAKDSSSEPPSMTQLLRR

SEQ ID NO: 39759 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKSGVSNKDIEKETAKDSSAEPPSMTQLLRR

SEQ ID NO: 39760 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKSGVSNKDIEKETAKDSAGEPPSMTQLLRR

SEQ ID NO: 39761 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKSGVSNKDIEKETAKDSASEPPSMTQLLRR

SEQ ID NO: 39762 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKSGVSNKDIEKETAKDSAAEPPSMTQLLRR

SEQ ID NO: 39763 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKSGVSNKDIEKETAKDAGGEPPSMTQLLRR

SEQ ID NO: 39764 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKSGVSNKDIEKETAKDAGSEPPSMTQLLRR

SEQ ID NO: 39765 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKSGVSNKDIEKETAKDAGAEPPSMTQLLRR

SEQ ID NO: 39766 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKSGVSNKDIEKETAKDASGEPPSMTQLLRR

SEQ ID NO: 39767 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKSGVSNKDIEKETAKDASSEPPSMTQLLRR

SEQ ID NO: 39768 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKSGVSNKDIEKETAKDASAEPPSMTQLLRR

SEQ ID NO: 39769 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKSGVSNKDIEKETAKDAAGEPPSMTQLLRR

SEQ ID NO: 39770 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKSGVSNKDIEKETAKDAASEPPSMTQLLRR

SEQ ID NO: 39771 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKSGVSNKDIEKETAKDAAAEPPSMTQLLRR

SEQ ID NO: 39772 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKAGVSNKDIEKETAKDGGGEPPSMTQLLRR

SEQ ID NO: 39773 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKAGVSNKDIEKETAKDGGSEPPSMTQLLRR

SEQ ID NO: 39774 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKAGVSNKDIEKETAKDGGAEPPSMTQLLRR

SEQ ID NO: 39775 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKAGVSNKDIEKETAKDGSGEPPSMTQLLRR

SEQ ID NO: 39776 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKAGVSNKDIEKETAKDGSSEPPSMTQLLRR

SEQ ID NO: 39777 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKAGVSNKDIEKETAKDGSAEPPSMTQLLRR

SEQ ID NO: 39778 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKAGVSNKDIEKETAKDGAGEPPSMTQLLRR

SEQ ID NO: 39779 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKAGVSNKDIEKETAKDGASEPPSMTQLLRR

SEQ ID NO: 39780 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKAGVSNKDIEKETAKDGAAEPPSMTQLLRR

SEQ ID NO: 39781 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKAGVSNKDIEKETAKDSGGEPPSMTQLLRR

SEQ ID NO: 39782 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKAGVSNKDIEKETAKDSGSEPPSMTQLLRR

SEQ ID NO: 39783 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKAGVSNKDIEKETAKDSGAEPPSMTQLLRR

SEQ ID NO: 39784 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKAGVSNKDIEKETAKDSSGEPPSMTQLLRR

SEQ ID NO: 39785 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKAGVSNKDIEKETAKDSSSEPPSMTQLLRR

SEQ ID NO: 39786 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKAGVSNKDIEKETAKDSSAEPPSMTQLLRR

SEQ ID NO: 39787 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKAGVSNKDIEKETAKDSAGEPPSMTQLLRR

SEQ ID NO: 39788 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKAGVSNKDIEKETAKDSASEPPSMTQLLRR

SEQ ID NO: 39789 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKAGVSNKDIEKETAKDSAAEPPSMTQLLRR

SEQ ID NO: 39790 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKAGVSNKDIEKETAKDAGGEPPSMTQLLRR

SEQ ID NO: 39791 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKAGVSNKDIEKETAKDAGSEPPSMTQLLRR

SEQ ID NO: 39792 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKAGVSNKDIEKETAKDAGAEPPSMTQLLRR

SEQ ID NO: 39793 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKAGVSNKDIEKETAKDASGEPPSMTQLLRR

SEQ ID NO: 39794 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKAGVSNKDIEKETAKDASSEPPSMTQLLRR

SEQ ID NO: 39795 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKAGVSNKDIEKETAKDASAEPPSMTQLLRR

SEQ ID NO: 39796 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKAGVSNKDIEKETAKDAAGEPPSMTQLLRR

SEQ ID NO: 39797 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKAGVSNKDIEKETAKDAASEPPSMTQLLRR

SEQ ID NO: 39798 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKAGVSNKDIEKETAKDAAAEPPSMTQLLRR

SEQ ID NO: 39799 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKGGVSNKDIEKETAKDGGGEPPSMTQLLRR

SEQ ID NO: 39800 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKGGVSNKDIEKETAKDGGSEPPSMTQLLRR

SEQ ID NO: 39801 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKGGVSNKDIEKETAKDGGAEPPSMTQLLRR

SEQ ID NO: 39802 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKGGVSNKDIEKETAKDGSGEPPSMTQLLRR

SEQ ID NO: 39803 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKGGVSNKDIEKETAKDGSSEPPSMTQLLRR

SEQ ID NO: 39804 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKGGVSNKDIEKETAKDGSAEPPSMTQLLRR

SEQ ID NO: 39805 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKGGVSNKDIEKETAKDGAGEPPSMTQLLRR

SEQ ID NO: 39806 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKGGVSNKDIEKETAKDGASEPPSMTQLLRR

SEQ ID NO: 39807 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKGGVSNKDIEKETAKDGAAEPPSMTQLLRR

SEQ ID NO: 39808 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKGGVSNKDIEKETAKDSGGEPPSMTQLLRR

SEQ ID NO: 39809 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKGGVSNKDIEKETAKDSGSEPPSMTQLLRR

SEQ ID NO: 39810 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKGGVSNKDIEKETAKDSGAEPPSMTQLLRR

SEQ ID NO: 39811 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKGGVSNKDIEKETAKDSSGEPPSMTQLLRR

SEQ ID NO: 39812 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKGGVSNKDIEKETAKDSSSEPPSMTQLLRR

SEQ ID NO: 39813 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKGGVSNKDIEKETAKDSSAEPPSMTQLLRR

SEQ ID NO: 39814 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKGGVSNKDIEKETAKDSAGEPPSMTQLLRR

SEQ ID NO: 39815 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKGGVSNKDIEKETAKDSASEPPSMTQLLRR

SEQ ID NO: 39816 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKGGVSNKDIEKETAKDSAAEPPSMTQLLRR

SEQ ID NO: 39817 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKGGVSNKDIEKETAKDAGGEPPSMTQLLRR

SEQ ID NO: 39818 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKGGVSNKDIEKETAKDAGSEPPSMTQLLRR

SEQ ID NO: 39819 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKGGVSNKDIEKETAKDAGAEPPSMTQLLRR

SEQ ID NO: 39820 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKGGVSNKDIEKETAKDASGEPPSMTQLLRR

SEQ ID NO: 39821 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKGGVSNKDIEKETAKDASSEPPSMTQLLRR

SEQ ID NO: 39822 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKGGVSNKDIEKETAKDASAEPPSMTQLLRR

SEQ ID NO: 39823 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKGGVSNKDIEKETAKDAAGEPPSMTQLLRR

SEQ ID NO: 39824 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKGGVSNKDIEKETAKDAASEPPSMTQLLRR

SEQ ID NO: 39825 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKGGVSNKDIEKETAKDAAAEPPSMTQLLRR

SEQ ID NO: 39826 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKDGVSNKDIEKETAKDGGGEPPSMTQLLRR

SEQ ID NO: 39827 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKDGVSNKDIEKETAKDGGSEPPSMTQLLRR

SEQ ID NO: 39828 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKDGVSNKDIEKETAKDGGAEPPSMTQLLRR

SEQ ID NO: 39829 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKDGVSNKDIEKETAKDGSGEPPSMTQLLRR

SEQ ID NO: 39830 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKDGVSNKDIEKETAKDGSSEPPSMTQLLRR

SEQ ID NO: 39831 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKDGVSNKDIEKETAKDGSAEPPSMTQLLRR

SEQ ID NO: 39832 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKDGVSNKDIEKETAKDGAGEPPSMTQLLRR

SEQ ID NO: 39833 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKDGVSNKDIEKETAKDGASEPPSMTQLLRR

SEQ ID NO: 39834 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKDGVSNKDIEKETAKDGAAEPPSMTQLLRR

SEQ ID NO: 39835 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKDGVSNKDIEKETAKDSGGEPPSMTQLLRR

SEQ ID NO: 39836 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKDGVSNKDIEKETAKDSGSEPPSMTQLLRR

SEQ ID NO: 39837 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKDGVSNKDIEKETAKDSGAEPPSMTQLLRR

SEQ ID NO: 39838 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKDGVSNKDIEKETAKDSSGEPPSMTQLLRR

SEQ ID NO: 39839 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKDGVSNKDIEKETAKDSSSEPPSMTQLLRR

SEQ ID NO: 39840 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKDGVSNKDIEKETAKDSSAEPPSMTQLLRR

SEQ ID NO: 39841 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKDGVSNKDIEKETAKDSAGEPPSMTQLLRR

SEQ ID NO: 39842 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKDGVSNKDIEKETAKDSASEPPSMTQLLRR

SEQ ID NO: 39843 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKDGVSNKDIEKETAKDSAAEPPSMTQLLRR

SEQ ID NO: 39844 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKDGVSNKDIEKETAKDAGGEPPSMTQLLRR

SEQ ID NO: 39845 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKDGVSNKDIEKETAKDAGSEPPSMTQLLRR

SEQ ID NO: 39846 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKDGVSNKDIEKETAKDAGAEPPSMTQLLRR

SEQ ID NO: 39847 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKDGVSNKDIEKETAKDASGEPPSMTQLLRR

SEQ ID NO: 39848 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKDGVSNKDIEKETAKDASSEPPSMTQLLRR

SEQ ID NO: 39849 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKDGVSNKDIEKETAKDASAEPPSMTQLLRR

SEQ ID NO: 39850 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKDGVSNKDIEKETAKDAAGEPPSMTQLLRR

SEQ ID NO: 39851 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKDGVSNKDIEKETAKDAASEPPSMTQLLRR

SEQ ID NO: 39852 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKDGVSNKDIEKETAKDAAAEPPSMTQLLRR

SEQ ID NO: 39853 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKHGVSNKDIEKETAKDGGGEPPSMTQLLRR

SEQ ID NO: 39854 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKHGVSNKDIEKETAKDGGSEPPSMTQLLRR

SEQ ID NO: 39855 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKHGVSNKDIEKETAKDGGAEPPSMTQLLRR

SEQ ID NO: 39856 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKHGVSNKDIEKETAKDGSGEPPSMTQLLRR

SEQ ID NO: 39857 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKHGVSNKDIEKETAKDGSSEPPSMTQLLRR

SEQ ID NO: 39858 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKHGVSNKDIEKETAKDGSAEPPSMTQLLRR

SEQ ID NO: 39859 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKHGVSNKDIEKETAKDGAGEPPSMTQLLRR

SEQ ID NO: 39860 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKHGVSNKDIEKETAKDGASEPPSMTQLLRR

SEQ ID NO: 39861 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKHGVSNKDIEKETAKDGAAEPPSMTQLLRR

SEQ ID NO: 39862 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKHGVSNKDIEKETAKDSGGEPPSMTQLLRR

SEQ ID NO: 39863 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKHGVSNKDIEKETAKDSGSEPPSMTQLLRR

SEQ ID NO: 39864 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKHGVSNKDIEKETAKDSGAEPPSMTQLLRR

SEQ ID NO: 39865 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKHGVSNKDIEKETAKDSSGEPPSMTQLLRR

SEQ ID NO: 39866 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKHGVSNKDIEKETAKDSSSEPPSMTQLLRR

SEQ ID NO: 39867 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKHGVSNKDIEKETAKDSSAEPPSMTQLLRR

SEQ ID NO: 39868 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKHGVSNKDIEKETAKDSAGEPPSMTQLLRR

SEQ ID NO: 39869 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKHGVSNKDIEKETAKDSASEPPSMTQLLRR

SEQ ID NO: 39870 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKHGVSNKDIEKETAKDSAAEPPSMTQLLRR

SEQ ID NO: 39871 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKHGVSNKDIEKETAKDAGGEPPSMTQLLRR

SEQ ID NO: 39872 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKHGVSNKDIEKETAKDAGSEPPSMTQLLRR

SEQ ID NO: 39873 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKHGVSNKDIEKETAKDAGAEPPSMTQLLRR

SEQ ID NO: 39874 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKHGVSNKDIEKETAKDASGEPPSMTQLLRR

SEQ ID NO: 39875 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKHGVSNKDIEKETAKDASSEPPSMTQLLRR

SEQ ID NO: 39876 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKHGVSNKDIEKETAKDASAEPPSMTQLLRR

SEQ ID NO: 39877 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKHGVSNKDIEKETAKDAAGEPPSMTQLLRR

SEQ ID NO: 39878 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKHGVSNKDIEKETAKDAASEPPSMTQLLRR

SEQ ID NO: 39879 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKHGVSNKDIEKETAKDAAAEPPSMTQLLRR

SEQ ID NO: 39880 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKYGVSNKDIEKETAKDGGGEPPSMTQLLRR

SEQ ID NO: 39881 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKYGVSNKDIEKETAKDGGSEPPSMTQLLRR

SEQ ID NO: 39882 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKYGVSNKDIEKETAKDGGAEPPSMTQLLRR

SEQ ID NO: 39883 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKYGVSNKDIEKETAKDGSGEPPSMTQLLRR

SEQ ID NO: 39884 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKYGVSNKDIEKETAKDGSSEPPSMTQLLRR

SEQ ID NO: 39885 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKYGVSNKDIEKETAKDGSAEPPSMTQLLRR

SEQ ID NO: 39886 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKYGVSNKDIEKETAKDGAGEPPSMTQLLRR

SEQ ID NO: 39887 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKYGVSNKDIEKETAKDGASEPPSMTQLLRR

SEQ ID NO: 39888 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKYGVSNKDIEKETAKDGAAEPPSMTQLLRR

SEQ ID NO: 39889 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKYGVSNKDIEKETAKDSGGEPPSMTQLLRR

SEQ ID NO: 39890 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKYGVSNKDIEKETAKDSGSEPPSMTQLLRR

SEQ ID NO: 39891 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKYGVSNKDIEKETAKDSGAEPPSMTQLLRR

SEQ ID NO: 39892 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKYGVSNKDIEKETAKDSSGEPPSMTQLLRR

SEQ ID NO: 39893 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKYGVSNKDIEKETAKDSSSEPPSMTQLLRR

SEQ ID NO: 39894 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKYGVSNKDIEKETAKDSSAEPPSMTQLLRR

SEQ ID NO: 39895 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKYGVSNKDIEKETAKDSAGEPPSMTQLLRR

SEQ ID NO: 39896 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKYGVSNKDIEKETAKDSASEPPSMTQLLRR

SEQ ID NO: 39897 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKYGVSNKDIEKETAKDSAAEPPSMTQLLRR

SEQ ID NO: 39898 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKYGVSNKDIEKETAKDAGGEPPSMTQLLRR

SEQ ID NO: 39899 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKYGVSNKDIEKETAKDAGSEPPSMTQLLRR

SEQ ID NO: 39900 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKYGVSNKDIEKETAKDAGAEPPSMTQLLRR

SEQ ID NO: 39901 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKYGVSNKDIEKETAKDASGEPPSMTQLLRR

SEQ ID NO: 39902 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKYGVSNKDIEKETAKDASSEPPSMTQLLRR

SEQ ID NO: 39903 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKYGVSNKDIEKETAKDASAEPPSMTQLLRR

SEQ ID NO: 39904 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKYGVSNKDIEKETAKDAAGEPPSMTQLLRR

SEQ ID NO: 39905 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKYGVSNKDIEKETAKDAASEPPSMTQLLRR

SEQ ID NO: 39906 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKYGVSNKDIEKETAKDAAAEPPSMTQLLRR

SEQ ID NO: 39907 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKKGVSNKDIEKETAKDGGGEPPSMTQLLRR

SEQ ID NO: 39908 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKKGVSNKDIEKETAKDGGSEPPSMTQLLRR

SEQ ID NO: 39909 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKKGVSNKDIEKETAKDGGAEPPSMTQLLRR

SEQ ID NO: 39910 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKKGVSNKDIEKETAKDGSGEPPSMTQLLRR

SEQ ID NO: 39911 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKKGVSNKDIEKETAKDGSSEPPSMTQLLRR

SEQ ID NO: 39912 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKKGVSNKDIEKETAKDGSAEPPSMTQLLRR

SEQ ID NO: 39913 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKKGVSNKDIEKETAKDGAGEPPSMTQLLRR

SEQ ID NO: 39914 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKKGVSNKDIEKETAKDGASEPPSMTQLLRR

SEQ ID NO: 39915 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKKGVSNKDIEKETAKDGAAEPPSMTQLLRR

SEQ ID NO: 39916 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKKGVSNKDIEKETAKDSGGEPPSMTQLLRR

SEQ ID NO: 39917 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKKGVSNKDIEKETAKDSGSEPPSMTQLLRR

SEQ ID NO: 39918 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKKGVSNKDIEKETAKDSGAEPPSMTQLLRR

SEQ ID NO: 39919 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKKGVSNKDIEKETAKDSSGEPPSMTQLLRR

SEQ ID NO: 39920 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKKGVSNKDIEKETAKDSSSEPPSMTQLLRR

SEQ ID NO: 39921 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKKGVSNKDIEKETAKDSSAEPPSMTQLLRR

SEQ ID NO: 39922 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKKGVSNKDIEKETAKDSAGEPPSMTQLLRR

SEQ ID NO: 39923 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKKGVSNKDIEKETAKDSASEPPSMTQLLRR

SEQ ID NO: 39924 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKKGVSNKDIEKETAKDSAAEPPSMTQLLRR

SEQ ID NO: 39925 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKKGVSNKDIEKETAKDAGGEPPSMTQLLRR

SEQ ID NO: 39926 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKKGVSNKDIEKETAKDAGSEPPSMTQLLRR

SEQ ID NO: 39927 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKKGVSNKDIEKETAKDAGAEPPSMTQLLRR

SEQ ID NO: 39928 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKKGVSNKDIEKETAKDASGEPPSMTQLLRR

SEQ ID NO: 39929 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKKGVSNKDIEKETAKDASSEPPSMTQLLRR

SEQ ID NO: 39930 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKKGVSNKDIEKETAKDASAEPPSMTQLLRR

SEQ ID NO: 39931 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKKGVSNKDIEKETAKDAAGEPPSMTQLLRR

SEQ ID NO: 39932 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKKGVSNKDIEKETAKDAASEPPSMTQLLRR

SEQ ID NO: 39933 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKKGVSNKDIEKETAKDAAAEPPSMTQLLRR

SEQ ID NO: 39934 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKNGVSNKDIEKETAKDGGGEPPSMTQLLRR

SEQ ID NO: 39935 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKNGVSNKDIEKETAKDGGSEPPSMTQLLRR

SEQ ID NO: 39936 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKNGVSNKDIEKETAKDGGAEPPSMTQLLRR

SEQ ID NO: 39937 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKNGVSNKDIEKETAKDGSGEPPSMTQLLRR

SEQ ID NO: 39938 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKNGVSNKDIEKETAKDGSSEPPSMTQLLRR

SEQ ID NO: 39939 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKNGVSNKDIEKETAKDGSAEPPSMTQLLRR

SEQ ID NO: 39940 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKNGVSNKDIEKETAKDGAGEPPSMTQLLRR

SEQ ID NO: 39941 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKNGVSNKDIEKETAKDGASEPPSMTQLLRR

SEQ ID NO: 39942 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKNGVSNKDIEKETAKDGAAEPPSMTQLLRR

SEQ ID NO: 39943 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKNGVSNKDIEKETAKDSGGEPPSMTQLLRR

SEQ ID NO: 39944 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKNGVSNKDIEKETAKDSGSEPPSMTQLLRR

SEQ ID NO: 39945 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKNGVSNKDIEKETAKDSGAEPPSMTQLLRR

SEQ ID NO: 39946 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKNGVSNKDIEKETAKDSSGEPPSMTQLLRR

SEQ ID NO: 39947 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKNGVSNKDIEKETAKDSSSEPPSMTQLLRR

SEQ ID NO: 39948 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKNGVSNKDIEKETAKDSSAEPPSMTQLLRR

SEQ ID NO: 39949 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKNGVSNKDIEKETAKDSAGEPPSMTQLLRR

SEQ ID NO: 39950 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKNGVSNKDIEKETAKDSASEPPSMTQLLRR

SEQ ID NO: 39951 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKNGVSNKDIEKETAKDSAAEPPSMTQLLRR

SEQ ID NO: 39952 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKNGVSNKDIEKETAKDAGGEPPSMTQLLRR

SEQ ID NO: 39953 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKNGVSNKDIEKETAKDAGSEPPSMTQLLRR

SEQ ID NO: 39954 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKNGVSNKDIEKETAKDAGAEPPSMTQLLRR

SEQ ID NO: 39955 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKNGVSNKDIEKETAKDASGEPPSMTQLLRR

SEQ ID NO: 39956 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKNGVSNKDIEKETAKDASSEPPSMTQLLRR

SEQ ID NO: 39957 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKNGVSNKDIEKETAKDASAEPPSMTQLLRR

SEQ ID NO: 39958 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKNGVSNKDIEKETAKDAAGEPPSMTQLLRR

SEQ ID NO: 39959 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKNGVSNKDIEKETAKDAASEPPSMTQLLRR

SEQ ID NO: 39960 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKNGVSNKDIEKETAKDAAAEPPSMTQLLRR

SEQ ID NO: 39961 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKMGVSNKDIEKETAKDGGGEPPSMTQLLRR

SEQ ID NO: 39962 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKMGVSNKDIEKETAKDGGSEPPSMTQLLRR

SEQ ID NO: 39963 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKMGVSNKDIEKETAKDGGAEPPSMTQLLRR

SEQ ID NO: 39964 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKMGVSNKDIEKETAKDGSGEPPSMTQLLRR

SEQ ID NO: 39965 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKMGVSNKDIEKETAKDGSSEPPSMTQLLRR

SEQ ID NO: 39966 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKMGVSNKDIEKETAKDGSAEPPSMTQLLRR

SEQ ID NO: 39967 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKMGVSNKDIEKETAKDGAGEPPSMTQLLRR

SEQ ID NO: 39968 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKMGVSNKDIEKETAKDGASEPPSMTQLLRR

SEQ ID NO: 39969 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKMGVSNKDIEKETAKDGAAEPPSMTQLLRR

SEQ ID NO: 39970 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKMGVSNKDIEKETAKDSGGEPPSMTQLLRR

SEQ ID NO: 39971 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKMGVSNKDIEKETAKDSGSEPPSMTQLLRR

SEQ ID NO: 39972 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKMGVSNKDIEKETAKDSGAEPPSMTQLLRR

SEQ ID NO: 39973 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKMGVSNKDIEKETAKDSSGEPPSMTQLLRR

SEQ ID NO: 39974 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKMGVSNKDIEKETAKDSSSEPPSMTQLLRR

SEQ ID NO: 39975 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKMGVSNKDIEKETAKDSSAEPPSMTQLLRR

SEQ ID NO: 39976 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKMGVSNKDIEKETAKDSAGEPPSMTQLLRR

SEQ ID NO: 39977 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKMGVSNKDIEKETAKDSASEPPSMTQLLRR

SEQ ID NO: 39978 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKMGVSNKDIEKETAKDSAAEPPSMTQLLRR

SEQ ID NO: 39979 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKMGVSNKDIEKETAKDAGGEPPSMTQLLRR

SEQ ID NO: 39980 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKMGVSNKDIEKETAKDAGSEPPSMTQLLRR

SEQ ID NO: 39981 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKMGVSNKDIEKETAKDAGAEPPSMTQLLRR

SEQ ID NO: 39982 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKMGVSNKDIEKETAKDASGEPPSMTQLLRR

SEQ ID NO: 39983 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKMGVSNKDIEKETAKDASSEPPSMTQLLRR

SEQ ID NO: 39984 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKMGVSNKDIEKETAKDASAEPPSMTQLLRR

SEQ ID NO: 39985 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKMGVSNKDIEKETAKDAAGEPPSMTQLLRR

SEQ ID NO: 39986 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKMGVSNKDIEKETAKDAASEPPSMTQLLRR

SEQ ID NO: 39987 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKMGVSNKDIEKETAKDAAAEPPSMTQLLRR

SEQ ID NO: 39988 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKCGVSNKDIEKETAKDGGGEPPSMTQLLRR

SEQ ID NO: 39989 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKCGVSNKDIEKETAKDGGSEPPSMTQLLRR

SEQ ID NO: 39990 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKCGVSNKDIEKETAKDGGAEPPSMTQLLRR

SEQ ID NO: 39991 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKCGVSNKDIEKETAKDGSGEPPSMTQLLRR

SEQ ID NO: 39992 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKCGVSNKDIEKETAKDGSSEPPSMTQLLRR

SEQ ID NO: 39993 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKCGVSNKDIEKETAKDGSAEPPSMTQLLRR

SEQ ID NO: 39994 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKCGVSNKDIEKETAKDGAGEPPSMTQLLRR

SEQ ID NO: 39995 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKCGVSNKDIEKETAKDGASEPPSMTQLLRR

SEQ ID NO: 39996 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKCGVSNKDIEKETAKDGAAEPPSMTQLLRR

SEQ ID NO: 39997 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKCGVSNKDIEKETAKDSGGEPPSMTQLLRR

SEQ ID NO: 39998 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKCGVSNKDIEKETAKDSGSEPPSMTQLLRR

SEQ ID NO: 39999 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKCGVSNKDIEKETAKDSGAEPPSMTQLLRR

SEQ ID NO: 40000 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKCGVSNKDIEKETAKDSSGEPPSMTQLLRR

SEQ ID NO: 40001 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKCGVSNKDIEKETAKDSSSEPPSMTQLLRR

SEQ ID NO: 40002 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKCGVSNKDIEKETAKDSSAEPPSMTQLLRR

SEQ ID NO: 40003 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKCGVSNKDIEKETAKDSAGEPPSMTQLLRR

SEQ ID NO: 40004 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKCGVSNKDIEKETAKDSASEPPSMTQLLRR

SEQ ID NO: 40005 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKCGVSNKDIEKETAKDSAAEPPSMTQLLRR

SEQ ID NO: 40006 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKCGVSNKDIEKETAKDAGGEPPSMTQLLRR

SEQ ID NO: 40007 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKCGVSNKDIEKETAKDAGSEPPSMTQLLRR

SEQ ID NO: 40008 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKCGVSNKDIEKETAKDAGAEPPSMTQLLRR

SEQ ID NO: 40009 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKCGVSNKDIEKETAKDASGEPPSMTQLLRR

SEQ ID NO: 40010 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKCGVSNKDIEKETAKDASSEPPSMTQLLRR

SEQ ID NO: 40011 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKCGVSNKDIEKETAKDASAEPPSMTQLLRR

SEQ ID NO: 40012 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKCGVSNKDIEKETAKDAAGEPPSMTQLLRR

SEQ ID NO: 40013 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKCGVSNKDIEKETAKDAASEPPSMTQLLRR

SEQ ID NO: 40014 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKCGVSNKDIEKETAKDAAAEPPSMTQLLRR

SEQ ID NO: 40015 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKSGVSNKDIEKETAKDGGGEPPSMTQLLRR

SEQ ID NO: 40016 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKSGVSNKDIEKETAKDGGSEPPSMTQLLRR

SEQ ID NO: 40017 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKSGVSNKDIEKETAKDGGAEPPSMTQLLRR

SEQ ID NO: 40018 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKSGVSNKDIEKETAKDGSGEPPSMTQLLRR

SEQ ID NO: 40019 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKSGVSNKDIEKETAKDGSSEPPSMTQLLRR

SEQ ID NO: 40020 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKSGVSNKDIEKETAKDGSAEPPSMTQLLRR

SEQ ID NO: 40021 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKSGVSNKDIEKETAKDGAGEPPSMTQLLRR

SEQ ID NO: 40022 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKSGVSNKDIEKETAKDGASEPPSMTQLLRR

SEQ ID NO: 40023 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKSGVSNKDIEKETAKDGAAEPPSMTQLLRR

SEQ ID NO: 40024 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKSGVSNKDIEKETAKDSGGEPPSMTQLLRR

SEQ ID NO: 40025 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKSGVSNKDIEKETAKDSGSEPPSMTQLLRR

SEQ ID NO: 40026 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKSGVSNKDIEKETAKDSGAEPPSMTQLLRR

SEQ ID NO: 40027 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKSGVSNKDIEKETAKDSSGEPPSMTQLLRR

SEQ ID NO: 40028 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKSGVSNKDIEKETAKDSSSEPPSMTQLLRR

SEQ ID NO: 40029 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKSGVSNKDIEKETAKDSSAEPPSMTQLLRR

SEQ ID NO: 40030 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKSGVSNKDIEKETAKDSAGEPPSMTQLLRR

SEQ ID NO: 40031 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKSGVSNKDIEKETAKDSASEPPSMTQLLRR

SEQ ID NO: 40032 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKSGVSNKDIEKETAKDSAAEPPSMTQLLRR

SEQ ID NO: 40033 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKSGVSNKDIEKETAKDAGGEPPSMTQLLRR

SEQ ID NO: 40034 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKSGVSNKDIEKETAKDAGSEPPSMTQLLRR

SEQ ID NO: 40035 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKSGVSNKDIEKETAKDAGAEPPSMTQLLRR

SEQ ID NO: 40036 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKSGVSNKDIEKETAKDASGEPPSMTQLLRR

SEQ ID NO: 40037 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKSGVSNKDIEKETAKDASSEPPSMTQLLRR

SEQ ID NO: 40038 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKSGVSNKDIEKETAKDASAEPPSMTQLLRR

SEQ ID NO: 40039 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKSGVSNKDIEKETAKDAAGEPPSMTQLLRR

SEQ ID NO: 40040 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKSGVSNKDIEKETAKDAASEPPSMTQLLRR

SEQ ID NO: 40041 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKSGVSNKDIEKETAKDAAAEPPSMTQLLRR

SEQ ID NO: 40042 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKAGVSNKDIEKETAKDGGGEPPSMTQLLRR

SEQ ID NO: 40043 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKAGVSNKDIEKETAKDGGSEPPSMTQLLRR

SEQ ID NO: 40044 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKAGVSNKDIEKETAKDGGAEPPSMTQLLRR

SEQ ID NO: 40045 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKAGVSNKDIEKETAKDGSGEPPSMTQLLRR

SEQ ID NO: 40046 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKAGVSNKDIEKETAKDGSSEPPSMTQLLRR

SEQ ID NO: 40047 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKAGVSNKDIEKETAKDGSAEPPSMTQLLRR

SEQ ID NO: 40048 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKAGVSNKDIEKETAKDGAGEPPSMTQLLRR

SEQ ID NO: 40049 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKAGVSNKDIEKETAKDGASEPPSMTQLLRR

SEQ ID NO: 40050 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKAGVSNKDIEKETAKDGAAEPPSMTQLLRR

SEQ ID NO: 40051 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKAGVSNKDIEKETAKDSGGEPPSMTQLLRR

SEQ ID NO: 40052 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKAGVSNKDIEKETAKDSGSEPPSMTQLLRR

SEQ ID NO: 40053 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKAGVSNKDIEKETAKDSGAEPPSMTQLLRR

SEQ ID NO: 40054 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKAGVSNKDIEKETAKDSSGEPPSMTQLLRR

SEQ ID NO: 40055 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKAGVSNKDIEKETAKDSSSEPPSMTQLLRR

SEQ ID NO: 40056 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKAGVSNKDIEKETAKDSSAEPPSMTQLLRR

SEQ ID NO: 40057 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKAGVSNKDIEKETAKDSAGEPPSMTQLLRR

SEQ ID NO: 40058 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKAGVSNKDIEKETAKDSASEPPSMTQLLRR

SEQ ID NO: 40059 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKAGVSNKDIEKETAKDSAAEPPSMTQLLRR

SEQ ID NO: 40060 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKAGVSNKDIEKETAKDAGGEPPSMTQLLRR

SEQ ID NO: 40061 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKAGVSNKDIEKETAKDAGSEPPSMTQLLRR

SEQ ID NO: 40062 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKAGVSNKDIEKETAKDAGAEPPSMTQLLRR

SEQ ID NO: 40063 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKAGVSNKDIEKETAKDASGEPPSMTQLLRR

SEQ ID NO: 40064 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKAGVSNKDIEKETAKDASSEPPSMTQLLRR

SEQ ID NO: 40065 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKAGVSNKDIEKETAKDASAEPPSMTQLLRR

SEQ ID NO: 40066 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKAGVSNKDIEKETAKDAAGEPPSMTQLLRR

SEQ ID NO: 40067 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKAGVSNKDIEKETAKDAASEPPSMTQLLRR

SEQ ID NO: 40068 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKAGVSNKDIEKETAKDAAAEPPSMTQLLRR

SEQ ID NO: 40069 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKGGVSNKDIEKETAKDGGGEPPSMTQLLRR

SEQ ID NO: 40070 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKGGVSNKDIEKETAKDGGSEPPSMTQLLRR

SEQ ID NO: 40071 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKGGVSNKDIEKETAKDGGAEPPSMTQLLRR

SEQ ID NO: 40072 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKGGVSNKDIEKETAKDGSGEPPSMTQLLRR

SEQ ID NO: 40073 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKGGVSNKDIEKETAKDGSSEPPSMTQLLRR

SEQ ID NO: 40074 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKGGVSNKDIEKETAKDGSAEPPSMTQLLRR

SEQ ID NO: 40075 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKGGVSNKDIEKETAKDGAGEPPSMTQLLRR

SEQ ID NO: 40076 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKGGVSNKDIEKETAKDGASEPPSMTQLLRR

SEQ ID NO: 40077 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKGGVSNKDIEKETAKDGAAEPPSMTQLLRR

SEQ ID NO: 40078 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKGGVSNKDIEKETAKDSGGEPPSMTQLLRR

SEQ ID NO: 40079 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKGGVSNKDIEKETAKDSGSEPPSMTQLLRR

SEQ ID NO: 40080 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKGGVSNKDIEKETAKDSGAEPPSMTQLLRR

SEQ ID NO: 40081 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKGGVSNKDIEKETAKDSSGEPPSMTQLLRR

SEQ ID NO: 40082 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKGGVSNKDIEKETAKDSSSEPPSMTQLLRR

SEQ ID NO: 40083 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKGGVSNKDIEKETAKDSSAEPPSMTQLLRR

SEQ ID NO: 40084 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKGGVSNKDIEKETAKDSAGEPPSMTQLLRR

SEQ ID NO: 40085 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKGGVSNKDIEKETAKDSASEPPSMTQLLRR

SEQ ID NO: 40086 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKGGVSNKDIEKETAKDSAAEPPSMTQLLRR

SEQ ID NO: 40087 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKGGVSNKDIEKETAKDAGGEPPSMTQLLRR

SEQ ID NO: 40088 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKGGVSNKDIEKETAKDAGSEPPSMTQLLRR

SEQ ID NO: 40089 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKGGVSNKDIEKETAKDAGAEPPSMTQLLRR

SEQ ID NO: 40090 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKGGVSNKDIEKETAKDASGEPPSMTQLLRR

SEQ ID NO: 40091 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKGGVSNKDIEKETAKDASSEPPSMTQLLRR

SEQ ID NO: 40092 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKGGVSNKDIEKETAKDASAEPPSMTQLLRR

SEQ ID NO: 40093 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKGGVSNKDIEKETAKDAAGEPPSMTQLLRR

SEQ ID NO: 40094 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKGGVSNKDIEKETAKDAASEPPSMTQLLRR

SEQ ID NO: 40095 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKGGVSNKDIEKETAKDAAAEPPSMTQLLRR

SEQ ID NO: 40096 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKDGVSNKDIEKETAKDGGGEPPSMTQLLRR

SEQ ID NO: 40097 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKDGVSNKDIEKETAKDGGSEPPSMTQLLRR

SEQ ID NO: 40098 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKDGVSNKDIEKETAKDGGAEPPSMTQLLRR

SEQ ID NO: 40099 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKDGVSNKDIEKETAKDGSGEPPSMTQLLRR

SEQ ID NO: 40100 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKDGVSNKDIEKETAKDGSSEPPSMTQLLRR

SEQ ID NO: 40101 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKDGVSNKDIEKETAKDGSAEPPSMTQLLRR

SEQ ID NO: 40102 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKDGVSNKDIEKETAKDGAGEPPSMTQLLRR

SEQ ID NO: 40103 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKDGVSNKDIEKETAKDGASEPPSMTQLLRR

SEQ ID NO: 40104 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKDGVSNKDIEKETAKDGAAEPPSMTQLLRR

SEQ ID NO: 40105 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKDGVSNKDIEKETAKDSGGEPPSMTQLLRR

SEQ ID NO: 40106 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKDGVSNKDIEKETAKDSGSEPPSMTQLLRR

SEQ ID NO: 40107 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKDGVSNKDIEKETAKDSGAEPPSMTQLLRR

SEQ ID NO: 40108 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKDGVSNKDIEKETAKDSSGEPPSMTQLLRR

SEQ ID NO: 40109 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKDGVSNKDIEKETAKDSSSEPPSMTQLLRR

SEQ ID NO: 40110 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKDGVSNKDIEKETAKDSSAEPPSMTQLLRR

SEQ ID NO: 40111 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKDGVSNKDIEKETAKDSAGEPPSMTQLLRR

SEQ ID NO: 40112 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKDGVSNKDIEKETAKDSASEPPSMTQLLRR

SEQ ID NO: 40113 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKDGVSNKDIEKETAKDSAAEPPSMTQLLRR

SEQ ID NO: 40114 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKDGVSNKDIEKETAKDAGGEPPSMTQLLRR

SEQ ID NO: 40115 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKDGVSNKDIEKETAKDAGSEPPSMTQLLRR

SEQ ID NO: 40116 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKDGVSNKDIEKETAKDAGAEPPSMTQLLRR

SEQ ID NO: 40117 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKDGVSNKDIEKETAKDASGEPPSMTQLLRR

SEQ ID NO: 40118 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKDGVSNKDIEKETAKDASSEPPSMTQLLRR

SEQ ID NO: 40119 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKDGVSNKDIEKETAKDASAEPPSMTQLLRR

SEQ ID NO: 40120 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKDGVSNKDIEKETAKDAAGEPPSMTQLLRR

SEQ ID NO: 40121 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKDGVSNKDIEKETAKDAASEPPSMTQLLRR

SEQ ID NO: 40122 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKDGVSNKDIEKETAKDAAAEPPSMTQLLRR

SEQ ID NO: 40123 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKHGVSNKDIEKETAKDGGGEPPSMTQLLRR

SEQ ID NO: 40124 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKHGVSNKDIEKETAKDGGSEPPSMTQLLRR

SEQ ID NO: 40125 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKHGVSNKDIEKETAKDGGAEPPSMTQLLRR

SEQ ID NO: 40126 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKHGVSNKDIEKETAKDGSGEPPSMTQLLRR

SEQ ID NO: 40127 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKHGVSNKDIEKETAKDGSSEPPSMTQLLRR

SEQ ID NO: 40128 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKHGVSNKDIEKETAKDGSAEPPSMTQLLRR

SEQ ID NO: 40129 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKHGVSNKDIEKETAKDGAGEPPSMTQLLRR

SEQ ID NO: 40130 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKHGVSNKDIEKETAKDGASEPPSMTQLLRR

SEQ ID NO: 40131 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKHGVSNKDIEKETAKDGAAEPPSMTQLLRR

SEQ ID NO: 40132 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKHGVSNKDIEKETAKDSGGEPPSMTQLLRR

SEQ ID NO: 40133 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKHGVSNKDIEKETAKDSGSEPPSMTQLLRR

SEQ ID NO: 40134 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKHGVSNKDIEKETAKDSGAEPPSMTQLLRR

SEQ ID NO: 40135 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKHGVSNKDIEKETAKDSSGEPPSMTQLLRR

SEQ ID NO: 40136 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKHGVSNKDIEKETAKDSSSEPPSMTQLLRR

SEQ ID NO: 40137 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKHGVSNKDIEKETAKDSSAEPPSMTQLLRR

SEQ ID NO: 40138 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKHGVSNKDIEKETAKDSAGEPPSMTQLLRR

SEQ ID NO: 40139 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKHGVSNKDIEKETAKDSASEPPSMTQLLRR

SEQ ID NO: 40140 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKHGVSNKDIEKETAKDSAAEPPSMTQLLRR

SEQ ID NO: 40141 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKHGVSNKDIEKETAKDAGGEPPSMTQLLRR

SEQ ID NO: 40142 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKHGVSNKDIEKETAKDAGSEPPSMTQLLRR

SEQ ID NO: 40143 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKHGVSNKDIEKETAKDAGAEPPSMTQLLRR

SEQ ID NO: 40144 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKHGVSNKDIEKETAKDASGEPPSMTQLLRR

SEQ ID NO: 40145 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKHGVSNKDIEKETAKDASSEPPSMTQLLRR

SEQ ID NO: 40146 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKHGVSNKDIEKETAKDASAEPPSMTQLLRR

SEQ ID NO: 40147 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKHGVSNKDIEKETAKDAAGEPPSMTQLLRR

SEQ ID NO: 40148 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKHGVSNKDIEKETAKDAASEPPSMTQLLRR

SEQ ID NO: 40149 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKHGVSNKDIEKETAKDAAAEPPSMTQLLRR

SEQ ID NO: 40150 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKYGVSNKDIEKETAKDGGGEPPSMTQLLRR

SEQ ID NO: 40151 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKYGVSNKDIEKETAKDGGSEPPSMTQLLRR

SEQ ID NO: 40152 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKYGVSNKDIEKETAKDGGAEPPSMTQLLRR

SEQ ID NO: 40153 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKYGVSNKDIEKETAKDGSGEPPSMTQLLRR

SEQ ID NO: 40154 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKYGVSNKDIEKETAKDGSSEPPSMTQLLRR

SEQ ID NO: 40155 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKYGVSNKDIEKETAKDGSAEPPSMTQLLRR

SEQ ID NO: 40156 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKYGVSNKDIEKETAKDGAGEPPSMTQLLRR

SEQ ID NO: 40157 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKYGVSNKDIEKETAKDGASEPPSMTQLLRR

SEQ ID NO: 40158 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKYGVSNKDIEKETAKDGAAEPPSMTQLLRR

SEQ ID NO: 40159 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKYGVSNKDIEKETAKDSGGEPPSMTQLLRR

SEQ ID NO: 40160 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKYGVSNKDIEKETAKDSGSEPPSMTQLLRR

SEQ ID NO: 40161 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKYGVSNKDIEKETAKDSGAEPPSMTQLLRR

SEQ ID NO: 40162 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKYGVSNKDIEKETAKDSSGEPPSMTQLLRR

SEQ ID NO: 40163 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKYGVSNKDIEKETAKDSSSEPPSMTQLLRR

SEQ ID NO: 40164 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKYGVSNKDIEKETAKDSSAEPPSMTQLLRR

SEQ ID NO: 40165 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKYGVSNKDIEKETAKDSAGEPPSMTQLLRR

SEQ ID NO: 40166 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKYGVSNKDIEKETAKDSASEPPSMTQLLRR

SEQ ID NO: 40167 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKYGVSNKDIEKETAKDSAAEPPSMTQLLRR

SEQ ID NO: 40168 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKYGVSNKDIEKETAKDAGGEPPSMTQLLRR

SEQ ID NO: 40169 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKYGVSNKDIEKETAKDAGSEPPSMTQLLRR

SEQ ID NO: 40170 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKYGVSNKDIEKETAKDAGAEPPSMTQLLRR

SEQ ID NO: 40171 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKYGVSNKDIEKETAKDASGEPPSMTQLLRR

SEQ ID NO: 40172 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKYGVSNKDIEKETAKDASSEPPSMTQLLRR

SEQ ID NO: 40173 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKYGVSNKDIEKETAKDASAEPPSMTQLLRR

SEQ ID NO: 40174 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKYGVSNKDIEKETAKDAAGEPPSMTQLLRR

SEQ ID NO: 40175 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKYGVSNKDIEKETAKDAASEPPSMTQLLRR

SEQ ID NO: 40176 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKYGVSNKDIEKETAKDAAAEPPSMTQLLRR

SEQ ID NO: 40177 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKKGVSNKDIEKETAKDGGGEPPSMTQLLRR

SEQ ID NO: 40178 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKKGVSNKDIEKETAKDGGSEPPSMTQLLRR

SEQ ID NO: 40179 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKKGVSNKDIEKETAKDGGAEPPSMTQLLRR

SEQ ID NO: 40180 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKKGVSNKDIEKETAKDGSGEPPSMTQLLRR

SEQ ID NO: 40181 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKKGVSNKDIEKETAKDGSSEPPSMTQLLRR

SEQ ID NO: 40182 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKKGVSNKDIEKETAKDGSAEPPSMTQLLRR

SEQ ID NO: 40183 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKKGVSNKDIEKETAKDGAGEPPSMTQLLRR

SEQ ID NO: 40184 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKKGVSNKDIEKETAKDGASEPPSMTQLLRR

SEQ ID NO: 40185 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKKGVSNKDIEKETAKDGAAEPPSMTQLLRR

SEQ ID NO: 40186 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKKGVSNKDIEKETAKDSGGEPPSMTQLLRR

SEQ ID NO: 40187 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKKGVSNKDIEKETAKDSGSEPPSMTQLLRR

SEQ ID NO: 40188 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKKGVSNKDIEKETAKDSGAEPPSMTQLLRR

SEQ ID NO: 40189 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKKGVSNKDIEKETAKDSSGEPPSMTQLLRR

SEQ ID NO: 40190 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKKGVSNKDIEKETAKDSSSEPPSMTQLLRR

SEQ ID NO: 40191 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKKGVSNKDIEKETAKDSSAEPPSMTQLLRR

SEQ ID NO: 40192 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKKGVSNKDIEKETAKDSAGEPPSMTQLLRR

SEQ ID NO: 40193 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKKGVSNKDIEKETAKDSASEPPSMTQLLRR

SEQ ID NO: 40194 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKKGVSNKDIEKETAKDSAAEPPSMTQLLRR

SEQ ID NO: 40195 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKKGVSNKDIEKETAKDAGGEPPSMTQLLRR

SEQ ID NO: 40196 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKKGVSNKDIEKETAKDAGSEPPSMTQLLRR

SEQ ID NO: 40197 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKKGVSNKDIEKETAKDAGAEPPSMTQLLRR

SEQ ID NO: 40198 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKKGVSNKDIEKETAKDASGEPPSMTQLLRR

SEQ ID NO: 40199 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKKGVSNKDIEKETAKDASSEPPSMTQLLRR

SEQ ID NO: 40200 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKKGVSNKDIEKETAKDASAEPPSMTQLLRR

SEQ ID NO: 40201 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKKGVSNKDIEKETAKDAAGEPPSMTQLLRR

SEQ ID NO: 40202 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKKGVSNKDIEKETAKDAASEPPSMTQLLRR

SEQ ID NO: 40203 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKKGVSNKDIEKETAKDAAAEPPSMTQLLRR

SEQ ID NO: 40204 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKNGVSNKDIEKETAKDGGGEPPSMTQLLRR

SEQ ID NO: 40205 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKNGVSNKDIEKETAKDGGSEPPSMTQLLRR

SEQ ID NO: 40206 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKNGVSNKDIEKETAKDGGAEPPSMTQLLRR

SEQ ID NO: 40207 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKNGVSNKDIEKETAKDGSGEPPSMTQLLRR

SEQ ID NO: 40208 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKNGVSNKDIEKETAKDGSSEPPSMTQLLRR

SEQ ID NO: 40209 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKNGVSNKDIEKETAKDGSAEPPSMTQLLRR

SEQ ID NO: 40210 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKNGVSNKDIEKETAKDGAGEPPSMTQLLRR

SEQ ID NO: 40211 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKNGVSNKDIEKETAKDGASEPPSMTQLLRR

SEQ ID NO: 40212 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKNGVSNKDIEKETAKDGAAEPPSMTQLLRR

SEQ ID NO: 40213 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKNGVSNKDIEKETAKDSGGEPPSMTQLLRR

SEQ ID NO: 40214 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKNGVSNKDIEKETAKDSGSEPPSMTQLLRR

SEQ ID NO: 40215 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKNGVSNKDIEKETAKDSGAEPPSMTQLLRR

SEQ ID NO: 40216 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKNGVSNKDIEKETAKDSSGEPPSMTQLLRR

SEQ ID NO: 40217 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKNGVSNKDIEKETAKDSSSEPPSMTQLLRR

SEQ ID NO: 40218 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKNGVSNKDIEKETAKDSSAEPPSMTQLLRR

SEQ ID NO: 40219 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKNGVSNKDIEKETAKDSAGEPPSMTQLLRR

SEQ ID NO: 40220 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKNGVSNKDIEKETAKDSASEPPSMTQLLRR

SEQ ID NO: 40221 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKNGVSNKDIEKETAKDSAAEPPSMTQLLRR

SEQ ID NO: 40222 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKNGVSNKDIEKETAKDAGGEPPSMTQLLRR

SEQ ID NO: 40223 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKNGVSNKDIEKETAKDAGSEPPSMTQLLRR

SEQ ID NO: 40224 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKNGVSNKDIEKETAKDAGAEPPSMTQLLRR

SEQ ID NO: 40225 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKNGVSNKDIEKETAKDASGEPPSMTQLLRR

SEQ ID NO: 40226 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKNGVSNKDIEKETAKDASSEPPSMTQLLRR

SEQ ID NO: 40227 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKNGVSNKDIEKETAKDASAEPPSMTQLLRR

SEQ ID NO: 40228 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKNGVSNKDIEKETAKDAAGEPPSMTQLLRR

SEQ ID NO: 40229 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKNGVSNKDIEKETAKDAASEPPSMTQLLRR

SEQ ID NO: 40230 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKNGVSNKDIEKETAKDAAAEPPSMTQLLRR

SEQ ID NO: 40231 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKMGVSNKDIEKETAKDGGGEPPSMTQLLRR

SEQ ID NO: 40232 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKMGVSNKDIEKETAKDGGSEPPSMTQLLRR

SEQ ID NO: 40233 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKMGVSNKDIEKETAKDGGAEPPSMTQLLRR

SEQ ID NO: 40234 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKMGVSNKDIEKETAKDGSGEPPSMTQLLRR

SEQ ID NO: 40235 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKMGVSNKDIEKETAKDGSSEPPSMTQLLRR

SEQ ID NO: 40236 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKMGVSNKDIEKETAKDGSAEPPSMTQLLRR

SEQ ID NO: 40237 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKMGVSNKDIEKETAKDGAGEPPSMTQLLRR

SEQ ID NO: 40238 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKMGVSNKDIEKETAKDGASEPPSMTQLLRR

SEQ ID NO: 40239 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKMGVSNKDIEKETAKDGAAEPPSMTQLLRR

SEQ ID NO: 40240 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKMGVSNKDIEKETAKDSGGEPPSMTQLLRR

SEQ ID NO: 40241 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKMGVSNKDIEKETAKDSGSEPPSMTQLLRR

SEQ ID NO: 40242 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKMGVSNKDIEKETAKDSGAEPPSMTQLLRR

SEQ ID NO: 40243 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKMGVSNKDIEKETAKDSSGEPPSMTQLLRR

SEQ ID NO: 40244 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKMGVSNKDIEKETAKDSSSEPPSMTQLLRR

SEQ ID NO: 40245 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKMGVSNKDIEKETAKDSSAEPPSMTQLLRR

SEQ ID NO: 40246 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKMGVSNKDIEKETAKDSAGEPPSMTQLLRR

SEQ ID NO: 40247 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKMGVSNKDIEKETAKDSASEPPSMTQLLRR

SEQ ID NO: 40248 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKMGVSNKDIEKETAKDSAAEPPSMTQLLRR

SEQ ID NO: 40249 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKMGVSNKDIEKETAKDAGGEPPSMTQLLRR

SEQ ID NO: 40250 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKMGVSNKDIEKETAKDAGSEPPSMTQLLRR

SEQ ID NO: 40251 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKMGVSNKDIEKETAKDAGAEPPSMTQLLRR

SEQ ID NO: 40252 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKMGVSNKDIEKETAKDASGEPPSMTQLLRR

SEQ ID NO: 40253 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKMGVSNKDIEKETAKDASSEPPSMTQLLRR

SEQ ID NO: 40254 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKMGVSNKDIEKETAKDASAEPPSMTQLLRR

SEQ ID NO: 40255 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKMGVSNKDIEKETAKDAAGEPPSMTQLLRR

SEQ ID NO: 40256 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKMGVSNKDIEKETAKDAASEPPSMTQLLRR

SEQ ID NO: 40257 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKMGVSNKDIEKETAKDAAAEPPSMTQLLRR

SEQ ID NO: 40258 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKCGVSNKDIEKETAKDGGGEPPSMTQLLRR

SEQ ID NO: 40259 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKCGVSNKDIEKETAKDGGSEPPSMTQLLRR

SEQ ID NO: 40260 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKCGVSNKDIEKETAKDGGAEPPSMTQLLRR

SEQ ID NO: 40261 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKCGVSNKDIEKETAKDGSGEPPSMTQLLRR

SEQ ID NO: 40262 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKCGVSNKDIEKETAKDGSSEPPSMTQLLRR

SEQ ID NO: 40263 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKCGVSNKDIEKETAKDGSAEPPSMTQLLRR

SEQ ID NO: 40264 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKCGVSNKDIEKETAKDGAGEPPSMTQLLRR

SEQ ID NO: 40265 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKCGVSNKDIEKETAKDGASEPPSMTQLLRR

SEQ ID NO: 40266 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKCGVSNKDIEKETAKDGAAEPPSMTQLLRR

SEQ ID NO: 40267 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKCGVSNKDIEKETAKDSGGEPPSMTQLLRR

SEQ ID NO: 40268 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKCGVSNKDIEKETAKDSGSEPPSMTQLLRR

SEQ ID NO: 40269 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKCGVSNKDIEKETAKDSGAEPPSMTQLLRR

SEQ ID NO: 40270 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKCGVSNKDIEKETAKDSSGEPPSMTQLLRR

SEQ ID NO: 40271 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKCGVSNKDIEKETAKDSSSEPPSMTQLLRR

SEQ ID NO: 40272 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKCGVSNKDIEKETAKDSSAEPPSMTQLLRR

SEQ ID NO: 40273 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKCGVSNKDIEKETAKDSAGEPPSMTQLLRR

SEQ ID NO: 40274 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKCGVSNKDIEKETAKDSASEPPSMTQLLRR

SEQ ID NO: 40275 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKCGVSNKDIEKETAKDSAAEPPSMTQLLRR

SEQ ID NO: 40276 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKCGVSNKDIEKETAKDAGGEPPSMTQLLRR

SEQ ID NO: 40277 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKCGVSNKDIEKETAKDAGSEPPSMTQLLRR

SEQ ID NO: 40278 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKCGVSNKDIEKETAKDAGAEPPSMTQLLRR

SEQ ID NO: 40279 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKCGVSNKDIEKETAKDASGEPPSMTQLLRR

SEQ ID NO: 40280 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKCGVSNKDIEKETAKDASSEPPSMTQLLRR

SEQ ID NO: 40281 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKCGVSNKDIEKETAKDASAEPPSMTQLLRR

SEQ ID NO: 40282 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKCGVSNKDIEKETAKDAAGEPPSMTQLLRR

SEQ ID NO: 40283 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKCGVSNKDIEKETAKDAASEPPSMTQLLRR

SEQ ID NO: 40284 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKCGVSNKDIEKETAKDAAAEPPSMTQLLRR

SEQ ID NO: 40285 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKSGVSNKDIEKETAKDGGGEPPSMTQLLRR

SEQ ID NO: 40286 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKSGVSNKDIEKETAKDGGSEPPSMTQLLRR

SEQ ID NO: 40287 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKSGVSNKDIEKETAKDGGAEPPSMTQLLRR

SEQ ID NO: 40288 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKSGVSNKDIEKETAKDGSGEPPSMTQLLRR

SEQ ID NO: 40289 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKSGVSNKDIEKETAKDGSSEPPSMTQLLRR

SEQ ID NO: 40290 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKSGVSNKDIEKETAKDGSAEPPSMTQLLRR

SEQ ID NO: 40291 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKSGVSNKDIEKETAKDGAGEPPSMTQLLRR

SEQ ID NO: 40292 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKSGVSNKDIEKETAKDGASEPPSMTQLLRR

SEQ ID NO: 40293 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKSGVSNKDIEKETAKDGAAEPPSMTQLLRR

SEQ ID NO: 40294 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKSGVSNKDIEKETAKDSGGEPPSMTQLLRR

SEQ ID NO: 40295 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKSGVSNKDIEKETAKDSGSEPPSMTQLLRR

SEQ ID NO: 40296 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKSGVSNKDIEKETAKDSGAEPPSMTQLLRR

SEQ ID NO: 40297 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKSGVSNKDIEKETAKDSSGEPPSMTQLLRR

SEQ ID NO: 40298 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKSGVSNKDIEKETAKDSSSEPPSMTQLLRR

SEQ ID NO: 40299 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKSGVSNKDIEKETAKDSSAEPPSMTQLLRR

SEQ ID NO: 40300 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKSGVSNKDIEKETAKDSAGEPPSMTQLLRR

SEQ ID NO: 40301 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKSGVSNKDIEKETAKDSASEPPSMTQLLRR

SEQ ID NO: 40302 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKSGVSNKDIEKETAKDSAAEPPSMTQLLRR

SEQ ID NO: 40303 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKSGVSNKDIEKETAKDAGGEPPSMTQLLRR

SEQ ID NO: 40304 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKSGVSNKDIEKETAKDAGSEPPSMTQLLRR

SEQ ID NO: 40305 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKSGVSNKDIEKETAKDAGAEPPSMTQLLRR

SEQ ID NO: 40306 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKSGVSNKDIEKETAKDASGEPPSMTQLLRR

SEQ ID NO: 40307 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKSGVSNKDIEKETAKDASSEPPSMTQLLRR

SEQ ID NO: 40308 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKSGVSNKDIEKETAKDASAEPPSMTQLLRR

SEQ ID NO: 40309 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKSGVSNKDIEKETAKDAAGEPPSMTQLLRR

SEQ ID NO: 40310 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKSGVSNKDIEKETAKDAASEPPSMTQLLRR

SEQ ID NO: 40311 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKSGVSNKDIEKETAKDAAAEPPSMTQLLRR

SEQ ID NO: 40312 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKAGVSNKDIEKETAKDGGGEPPSMTQLLRR

SEQ ID NO: 40313 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKAGVSNKDIEKETAKDGGSEPPSMTQLLRR

SEQ ID NO: 40314 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKAGVSNKDIEKETAKDGGAEPPSMTQLLRR

SEQ ID NO: 40315 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKAGVSNKDIEKETAKDGSGEPPSMTQLLRR

SEQ ID NO: 40316 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKAGVSNKDIEKETAKDGSSEPPSMTQLLRR

SEQ ID NO: 40317 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKAGVSNKDIEKETAKDGSAEPPSMTQLLRR

SEQ ID NO: 40318 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKAGVSNKDIEKETAKDGAGEPPSMTQLLRR

SEQ ID NO: 40319 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKAGVSNKDIEKETAKDGASEPPSMTQLLRR

SEQ ID NO: 40320 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKAGVSNKDIEKETAKDGAAEPPSMTQLLRR

SEQ ID NO: 40321 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKAGVSNKDIEKETAKDSGGEPPSMTQLLRR

SEQ ID NO: 40322 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKAGVSNKDIEKETAKDSGSEPPSMTQLLRR

SEQ ID NO: 40323 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKAGVSNKDIEKETAKDSGAEPPSMTQLLRR

SEQ ID NO: 40324 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKAGVSNKDIEKETAKDSSGEPPSMTQLLRR

SEQ ID NO: 40325 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKAGVSNKDIEKETAKDSSSEPPSMTQLLRR

SEQ ID NO: 40326 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKAGVSNKDIEKETAKDSSAEPPSMTQLLRR

SEQ ID NO: 40327 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKAGVSNKDIEKETAKDSAGEPPSMTQLLRR

SEQ ID NO: 40328 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKAGVSNKDIEKETAKDSASEPPSMTQLLRR

SEQ ID NO: 40329 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKAGVSNKDIEKETAKDSAAEPPSMTQLLRR

SEQ ID NO: 40330 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKAGVSNKDIEKETAKDAGGEPPSMTQLLRR

SEQ ID NO: 40331 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKAGVSNKDIEKETAKDAGSEPPSMTQLLRR

SEQ ID NO: 40332 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKAGVSNKDIEKETAKDAGAEPPSMTQLLRR

SEQ ID NO: 40333 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKAGVSNKDIEKETAKDASGEPPSMTQLLRR

SEQ ID NO: 40334 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKAGVSNKDIEKETAKDASSEPPSMTQLLRR

SEQ ID NO: 40335 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKAGVSNKDIEKETAKDASAEPPSMTQLLRR

SEQ ID NO: 40336 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKAGVSNKDIEKETAKDAAGEPPSMTQLLRR

SEQ ID NO: 40337 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKAGVSNKDIEKETAKDAASEPPSMTQLLRR

SEQ ID NO: 40338 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKAGVSNKDIEKETAKDAAAEPPSMTQLLRR

SEQ ID NO: 40339 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKGGVSNKDIEKETAKDGGGEPPSMTQLLRR

SEQ ID NO: 40340 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKGGVSNKDIEKETAKDGGSEPPSMTQLLRR

SEQ ID NO: 40341 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKGGVSNKDIEKETAKDGGAEPPSMTQLLRR

SEQ ID NO: 40342 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKGGVSNKDIEKETAKDGSGEPPSMTQLLRR

SEQ ID NO: 40343 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKGGVSNKDIEKETAKDGSSEPPSMTQLLRR

SEQ ID NO: 40344 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKGGVSNKDIEKETAKDGSAEPPSMTQLLRR

SEQ ID NO: 40345 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKGGVSNKDIEKETAKDGAGEPPSMTQLLRR

SEQ ID NO: 40346 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKGGVSNKDIEKETAKDGASEPPSMTQLLRR

SEQ ID NO: 40347 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKGGVSNKDIEKETAKDGAAEPPSMTQLLRR

SEQ ID NO: 40348 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKGGVSNKDIEKETAKDSGGEPPSMTQLLRR

SEQ ID NO: 40349 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKGGVSNKDIEKETAKDSGSEPPSMTQLLRR

SEQ ID NO: 40350 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKGGVSNKDIEKETAKDSGAEPPSMTQLLRR

SEQ ID NO: 40351 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKGGVSNKDIEKETAKDSSGEPPSMTQLLRR

SEQ ID NO: 40352 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKGGVSNKDIEKETAKDSSSEPPSMTQLLRR

SEQ ID NO: 40353 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKGGVSNKDIEKETAKDSSAEPPSMTQLLRR

SEQ ID NO: 40354 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKGGVSNKDIEKETAKDSAGEPPSMTQLLRR

SEQ ID NO: 40355 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKGGVSNKDIEKETAKDSASEPPSMTQLLRR

SEQ ID NO: 40356 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKGGVSNKDIEKETAKDSAAEPPSMTQLLRR

SEQ ID NO: 40357 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKGGVSNKDIEKETAKDAGGEPPSMTQLLRR

SEQ ID NO: 40358 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKGGVSNKDIEKETAKDAGSEPPSMTQLLRR

SEQ ID NO: 40359 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKGGVSNKDIEKETAKDAGAEPPSMTQLLRR

SEQ ID NO: 40360 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKGGVSNKDIEKETAKDASGEPPSMTQLLRR

SEQ ID NO: 40361 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKGGVSNKDIEKETAKDASSEPPSMTQLLRR

SEQ ID NO: 40362 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKGGVSNKDIEKETAKDASAEPPSMTQLLRR

SEQ ID NO: 40363 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKGGVSNKDIEKETAKDAAGEPPSMTQLLRR

SEQ ID NO: 40364 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKGGVSNKDIEKETAKDAASEPPSMTQLLRR

SEQ ID NO: 40365 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKGGVSNKDIEKETAKDAAAEPPSMTQLLRR

SEQ ID NO: 40366 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKDGVSNKDIEKETAKDGGGEPPSMTQLLRR

SEQ ID NO: 40367 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKDGVSNKDIEKETAKDGGSEPPSMTQLLRR

SEQ ID NO: 40368 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKDGVSNKDIEKETAKDGGAEPPSMTQLLRR

SEQ ID NO: 40369 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKDGVSNKDIEKETAKDGSGEPPSMTQLLRR

SEQ ID NO: 40370 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKDGVSNKDIEKETAKDGSSEPPSMTQLLRR

SEQ ID NO: 40371 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKDGVSNKDIEKETAKDGSAEPPSMTQLLRR

SEQ ID NO: 40372 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKDGVSNKDIEKETAKDGAGEPPSMTQLLRR

SEQ ID NO: 40373 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKDGVSNKDIEKETAKDGASEPPSMTQLLRR

SEQ ID NO: 40374 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKDGVSNKDIEKETAKDGAAEPPSMTQLLRR

SEQ ID NO: 40375 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKDGVSNKDIEKETAKDSGGEPPSMTQLLRR

SEQ ID NO: 40376 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKDGVSNKDIEKETAKDSGSEPPSMTQLLRR

SEQ ID NO: 40377 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKDGVSNKDIEKETAKDSGAEPPSMTQLLRR

SEQ ID NO: 40378 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKDGVSNKDIEKETAKDSSGEPPSMTQLLRR

SEQ ID NO: 40379 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKDGVSNKDIEKETAKDSSSEPPSMTQLLRR

SEQ ID NO: 40380 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKDGVSNKDIEKETAKDSSAEPPSMTQLLRR

SEQ ID NO: 40381 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKDGVSNKDIEKETAKDSAGEPPSMTQLLRR

SEQ ID NO: 40382 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKDGVSNKDIEKETAKDSASEPPSMTQLLRR

SEQ ID NO: 40383 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKDGVSNKDIEKETAKDSAAEPPSMTQLLRR

SEQ ID NO: 40384 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKDGVSNKDIEKETAKDAGGEPPSMTQLLRR

SEQ ID NO: 40385 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKDGVSNKDIEKETAKDAGSEPPSMTQLLRR

SEQ ID NO: 40386 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKDGVSNKDIEKETAKDAGAEPPSMTQLLRR

SEQ ID NO: 40387 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKDGVSNKDIEKETAKDASGEPPSMTQLLRR

SEQ ID NO: 40388 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKDGVSNKDIEKETAKDASSEPPSMTQLLRR

SEQ ID NO: 40389 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKDGVSNKDIEKETAKDASAEPPSMTQLLRR

SEQ ID NO: 40390 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKDGVSNKDIEKETAKDAAGEPPSMTQLLRR

SEQ ID NO: 40391 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKDGVSNKDIEKETAKDAASEPPSMTQLLRR

SEQ ID NO: 40392 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKDGVSNKDIEKETAKDAAAEPPSMTQLLRR

SEQ ID NO: 40393 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKHGVSNKDIEKETAKDGGGEPPSMTQLLRR

SEQ ID NO: 40394 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKHGVSNKDIEKETAKDGGSEPPSMTQLLRR

SEQ ID NO: 40395 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKHGVSNKDIEKETAKDGGAEPPSMTQLLRR

SEQ ID NO: 40396 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKHGVSNKDIEKETAKDGSGEPPSMTQLLRR

SEQ ID NO: 40397 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKHGVSNKDIEKETAKDGSSEPPSMTQLLRR

SEQ ID NO: 40398 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKHGVSNKDIEKETAKDGSAEPPSMTQLLRR

SEQ ID NO: 40399 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKHGVSNKDIEKETAKDGAGEPPSMTQLLRR

SEQ ID NO: 40400 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKHGVSNKDIEKETAKDGASEPPSMTQLLRR

SEQ ID NO: 40401 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKHGVSNKDIEKETAKDGAAEPPSMTQLLRR

SEQ ID NO: 40402 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKHGVSNKDIEKETAKDSGGEPPSMTQLLRR

SEQ ID NO: 40403 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKHGVSNKDIEKETAKDSGSEPPSMTQLLRR

SEQ ID NO: 40404 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKHGVSNKDIEKETAKDSGAEPPSMTQLLRR

SEQ ID NO: 40405 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKHGVSNKDIEKETAKDSSGEPPSMTQLLRR

SEQ ID NO: 40406 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKHGVSNKDIEKETAKDSSSEPPSMTQLLRR

SEQ ID NO: 40407 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKHGVSNKDIEKETAKDSSAEPPSMTQLLRR

SEQ ID NO: 40408 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKHGVSNKDIEKETAKDSAGEPPSMTQLLRR

SEQ ID NO: 40409 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKHGVSNKDIEKETAKDSASEPPSMTQLLRR

SEQ ID NO: 40410 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKHGVSNKDIEKETAKDSAAEPPSMTQLLRR

SEQ ID NO: 40411 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKHGVSNKDIEKETAKDAGGEPPSMTQLLRR

SEQ ID NO: 40412 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKHGVSNKDIEKETAKDAGSEPPSMTQLLRR

SEQ ID NO: 40413 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKHGVSNKDIEKETAKDAGAEPPSMTQLLRR

SEQ ID NO: 40414 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKHGVSNKDIEKETAKDASGEPPSMTQLLRR

SEQ ID NO: 40415 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKHGVSNKDIEKETAKDASSEPPSMTQLLRR

SEQ ID NO: 40416 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKHGVSNKDIEKETAKDASAEPPSMTQLLRR

SEQ ID NO: 40417 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKHGVSNKDIEKETAKDAAGEPPSMTQLLRR

SEQ ID NO: 40418 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKHGVSNKDIEKETAKDAASEPPSMTQLLRR

SEQ ID NO: 40419 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKHGVSNKDIEKETAKDAAAEPPSMTQLLRR

SEQ ID NO: 40420 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKYGVSNKDIEKETAKDGGGEPPSMTQLLRR

SEQ ID NO: 40421 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKYGVSNKDIEKETAKDGGSEPPSMTQLLRR

SEQ ID NO: 40422 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKYGVSNKDIEKETAKDGGAEPPSMTQLLRR

SEQ ID NO: 40423 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKYGVSNKDIEKETAKDGSGEPPSMTQLLRR

SEQ ID NO: 40424 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKYGVSNKDIEKETAKDGSSEPPSMTQLLRR

SEQ ID NO: 40425 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKYGVSNKDIEKETAKDGSAEPPSMTQLLRR

SEQ ID NO: 40426 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKYGVSNKDIEKETAKDGAGEPPSMTQLLRR

SEQ ID NO: 40427 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKYGVSNKDIEKETAKDGASEPPSMTQLLRR

SEQ ID NO: 40428 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKYGVSNKDIEKETAKDGAAEPPSMTQLLRR

SEQ ID NO: 40429 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKYGVSNKDIEKETAKDSGGEPPSMTQLLRR

SEQ ID NO: 40430 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKYGVSNKDIEKETAKDSGSEPPSMTQLLRR

SEQ ID NO: 40431 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKYGVSNKDIEKETAKDSGAEPPSMTQLLRR

SEQ ID NO: 40432 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKYGVSNKDIEKETAKDSSGEPPSMTQLLRR

SEQ ID NO: 40433 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKYGVSNKDIEKETAKDSSSEPPSMTQLLRR

SEQ ID NO: 40434 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKYGVSNKDIEKETAKDSSAEPPSMTQLLRR

SEQ ID NO: 40435 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKYGVSNKDIEKETAKDSAGEPPSMTQLLRR

SEQ ID NO: 40436 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKYGVSNKDIEKETAKDSASEPPSMTQLLRR

SEQ ID NO: 40437 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKYGVSNKDIEKETAKDSAAEPPSMTQLLRR

SEQ ID NO: 40438 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKYGVSNKDIEKETAKDAGGEPPSMTQLLRR

SEQ ID NO: 40439 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKYGVSNKDIEKETAKDAGSEPPSMTQLLRR

SEQ ID NO: 40440 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKYGVSNKDIEKETAKDAGAEPPSMTQLLRR

SEQ ID NO: 40441 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKYGVSNKDIEKETAKDASGEPPSMTQLLRR

SEQ ID NO: 40442 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKYGVSNKDIEKETAKDASSEPPSMTQLLRR

SEQ ID NO: 40443 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKYGVSNKDIEKETAKDASAEPPSMTQLLRR

SEQ ID NO: 40444 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKYGVSNKDIEKETAKDAAGEPPSMTQLLRR

SEQ ID NO: 40445 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKYGVSNKDIEKETAKDAASEPPSMTQLLRR

SEQ ID NO: 40446 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKYGVSNKDIEKETAKDAAAEPPSMTQLLRR

SEQ ID NO: 40447 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKKGVSNKDIEKETAKDGGGEPPSMTQLLRR

SEQ ID NO: 40448 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKKGVSNKDIEKETAKDGGSEPPSMTQLLRR

SEQ ID NO: 40449 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKKGVSNKDIEKETAKDGGAEPPSMTQLLRR

SEQ ID NO: 40450 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKKGVSNKDIEKETAKDGSGEPPSMTQLLRR

SEQ ID NO: 40451 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKKGVSNKDIEKETAKDGSSEPPSMTQLLRR

SEQ ID NO: 40452 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKKGVSNKDIEKETAKDGSAEPPSMTQLLRR

SEQ ID NO: 40453 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKKGVSNKDIEKETAKDGAGEPPSMTQLLRR

SEQ ID NO: 40454 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKKGVSNKDIEKETAKDGASEPPSMTQLLRR

SEQ ID NO: 40455 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKKGVSNKDIEKETAKDGAAEPPSMTQLLRR

SEQ ID NO: 40456 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKKGVSNKDIEKETAKDSGGEPPSMTQLLRR

SEQ ID NO: 40457 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKKGVSNKDIEKETAKDSGSEPPSMTQLLRR

SEQ ID NO: 40458 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKKGVSNKDIEKETAKDSGAEPPSMTQLLRR

SEQ ID NO: 40459 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKKGVSNKDIEKETAKDSSGEPPSMTQLLRR

SEQ ID NO: 40460 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKKGVSNKDIEKETAKDSSSEPPSMTQLLRR

SEQ ID NO: 40461 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKKGVSNKDIEKETAKDSSAEPPSMTQLLRR

SEQ ID NO: 40462 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKKGVSNKDIEKETAKDSAGEPPSMTQLLRR

SEQ ID NO: 40463 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKKGVSNKDIEKETAKDSASEPPSMTQLLRR

SEQ ID NO: 40464 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKKGVSNKDIEKETAKDSAAEPPSMTQLLRR

SEQ ID NO: 40465 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKKGVSNKDIEKETAKDAGGEPPSMTQLLRR

SEQ ID NO: 40466 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKKGVSNKDIEKETAKDAGSEPPSMTQLLRR

SEQ ID NO: 40467 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKKGVSNKDIEKETAKDAGAEPPSMTQLLRR

SEQ ID NO: 40468 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKKGVSNKDIEKETAKDASGEPPSMTQLLRR

SEQ ID NO: 40469 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKKGVSNKDIEKETAKDASSEPPSMTQLLRR

SEQ ID NO: 40470 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKKGVSNKDIEKETAKDASAEPPSMTQLLRR

SEQ ID NO: 40471 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKKGVSNKDIEKETAKDAAGEPPSMTQLLRR

SEQ ID NO: 40472 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKKGVSNKDIEKETAKDAASEPPSMTQLLRR

SEQ ID NO: 40473 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKKGVSNKDIEKETAKDAAAEPPSMTQLLRR

SEQ ID NO: 40474 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKNGVSNKDIEKETAKDGGGEPPSMTQLLRR

SEQ ID NO: 40475 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKNGVSNKDIEKETAKDGGSEPPSMTQLLRR

SEQ ID NO: 40476 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKNGVSNKDIEKETAKDGGAEPPSMTQLLRR

SEQ ID NO: 40477 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKNGVSNKDIEKETAKDGSGEPPSMTQLLRR

SEQ ID NO: 40478 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKNGVSNKDIEKETAKDGSSEPPSMTQLLRR

SEQ ID NO: 40479 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKNGVSNKDIEKETAKDGSAEPPSMTQLLRR

SEQ ID NO: 40480 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKNGVSNKDIEKETAKDGAGEPPSMTQLLRR

SEQ ID NO: 40481 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKNGVSNKDIEKETAKDGASEPPSMTQLLRR

SEQ ID NO: 40482 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKNGVSNKDIEKETAKDGAAEPPSMTQLLRR

SEQ ID NO: 40483 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKNGVSNKDIEKETAKDSGGEPPSMTQLLRR

SEQ ID NO: 40484 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKNGVSNKDIEKETAKDSGSEPPSMTQLLRR

SEQ ID NO: 40485 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKNGVSNKDIEKETAKDSGAEPPSMTQLLRR

SEQ ID NO: 40486 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKNGVSNKDIEKETAKDSSGEPPSMTQLLRR

SEQ ID NO: 40487 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKNGVSNKDIEKETAKDSSSEPPSMTQLLRR

SEQ ID NO: 40488 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKNGVSNKDIEKETAKDSSAEPPSMTQLLRR

SEQ ID NO: 40489 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKNGVSNKDIEKETAKDSAGEPPSMTQLLRR

SEQ ID NO: 40490 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKNGVSNKDIEKETAKDSASEPPSMTQLLRR

SEQ ID NO: 40491 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKNGVSNKDIEKETAKDSAAEPPSMTQLLRR

SEQ ID NO: 40492 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKNGVSNKDIEKETAKDAGGEPPSMTQLLRR

SEQ ID NO: 40493 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKNGVSNKDIEKETAKDAGSEPPSMTQLLRR

SEQ ID NO: 40494 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKNGVSNKDIEKETAKDAGAEPPSMTQLLRR

SEQ ID NO: 40495 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKNGVSNKDIEKETAKDASGEPPSMTQLLRR

SEQ ID NO: 40496 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKNGVSNKDIEKETAKDASSEPPSMTQLLRR

SEQ ID NO: 40497 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKNGVSNKDIEKETAKDASAEPPSMTQLLRR

SEQ ID NO: 40498 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKNGVSNKDIEKETAKDAAGEPPSMTQLLRR

SEQ ID NO: 40499 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKNGVSNKDIEKETAKDAASEPPSMTQLLRR

SEQ ID NO: 40500 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKNGVSNKDIEKETAKDAAAEPPSMTQLLRR

SEQ ID NO: 40501 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKMGVSNKDIEKETAKDGGGEPPSMTQLLRR

SEQ ID NO: 40502 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKMGVSNKDIEKETAKDGGSEPPSMTQLLRR

SEQ ID NO: 40503 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKMGVSNKDIEKETAKDGGAEPPSMTQLLRR

SEQ ID NO: 40504 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKMGVSNKDIEKETAKDGSGEPPSMTQLLRR

SEQ ID NO: 40505 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKMGVSNKDIEKETAKDGSSEPPSMTQLLRR

SEQ ID NO: 40506 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKMGVSNKDIEKETAKDGSAEPPSMTQLLRR

SEQ ID NO: 40507 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKMGVSNKDIEKETAKDGAGEPPSMTQLLRR

SEQ ID NO: 40508 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKMGVSNKDIEKETAKDGASEPPSMTQLLRR

SEQ ID NO: 40509 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKMGVSNKDIEKETAKDGAAEPPSMTQLLRR

SEQ ID NO: 40510 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKMGVSNKDIEKETAKDSGGEPPSMTQLLRR

SEQ ID NO: 40511 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKMGVSNKDIEKETAKDSGSEPPSMTQLLRR

SEQ ID NO: 40512 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKMGVSNKDIEKETAKDSGAEPPSMTQLLRR

SEQ ID NO: 40513 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKMGVSNKDIEKETAKDSSGEPPSMTQLLRR

SEQ ID NO: 40514 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKMGVSNKDIEKETAKDSSSEPPSMTQLLRR

SEQ ID NO: 40515 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKMGVSNKDIEKETAKDSSAEPPSMTQLLRR

SEQ ID NO: 40516 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKMGVSNKDIEKETAKDSAGEPPSMTQLLRR

SEQ ID NO: 40517 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKMGVSNKDIEKETAKDSASEPPSMTQLLRR

SEQ ID NO: 40518 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKMGVSNKDIEKETAKDSAAEPPSMTQLLRR

SEQ ID NO: 40519 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKMGVSNKDIEKETAKDAGGEPPSMTQLLRR

SEQ ID NO: 40520 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKMGVSNKDIEKETAKDAGSEPPSMTQLLRR

SEQ ID NO: 40521 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKMGVSNKDIEKETAKDAGAEPPSMTQLLRR

SEQ ID NO: 40522 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKMGVSNKDIEKETAKDASGEPPSMTQLLRR

SEQ ID NO: 40523 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKMGVSNKDIEKETAKDASSEPPSMTQLLRR

SEQ ID NO: 40524 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKMGVSNKDIEKETAKDASAEPPSMTQLLRR

SEQ ID NO: 40525 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKMGVSNKDIEKETAKDAAGEPPSMTQLLRR

SEQ ID NO: 40526 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKMGVSNKDIEKETAKDAASEPPSMTQLLRR

SEQ ID NO: 40527 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKMGVSNKDIEKETAKDAAAEPPSMTQLLRR

SEQ ID NO: 40528 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKCGVSNKDIEKETAKDGGGEPPSMTQLLRR

SEQ ID NO: 40529 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKCGVSNKDIEKETAKDGGSEPPSMTQLLRR

SEQ ID NO: 40530 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKCGVSNKDIEKETAKDGGAEPPSMTQLLRR

SEQ ID NO: 40531 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKCGVSNKDIEKETAKDGSGEPPSMTQLLRR

SEQ ID NO: 40532 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKCGVSNKDIEKETAKDGSSEPPSMTQLLRR

SEQ ID NO: 40533 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKCGVSNKDIEKETAKDGSAEPPSMTQLLRR

SEQ ID NO: 40534 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKCGVSNKDIEKETAKDGAGEPPSMTQLLRR

SEQ ID NO: 40535 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKCGVSNKDIEKETAKDGASEPPSMTQLLRR

SEQ ID NO: 40536 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKCGVSNKDIEKETAKDGAAEPPSMTQLLRR

SEQ ID NO: 40537 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKCGVSNKDIEKETAKDSGGEPPSMTQLLRR

SEQ ID NO: 40538 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKCGVSNKDIEKETAKDSGSEPPSMTQLLRR

SEQ ID NO: 40539 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKCGVSNKDIEKETAKDSGAEPPSMTQLLRR

SEQ ID NO: 40540 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKCGVSNKDIEKETAKDSSGEPPSMTQLLRR

SEQ ID NO: 40541 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKCGVSNKDIEKETAKDSSSEPPSMTQLLRR

SEQ ID NO: 40542 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKCGVSNKDIEKETAKDSSAEPPSMTQLLRR

SEQ ID NO: 40543 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKCGVSNKDIEKETAKDSAGEPPSMTQLLRR

SEQ ID NO: 40544 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKCGVSNKDIEKETAKDSASEPPSMTQLLRR

SEQ ID NO: 40545 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKCGVSNKDIEKETAKDSAAEPPSMTQLLRR

SEQ ID NO: 40546 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKCGVSNKDIEKETAKDAGGEPPSMTQLLRR

SEQ ID NO: 40547 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKCGVSNKDIEKETAKDAGSEPPSMTQLLRR

SEQ ID NO: 40548 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKCGVSNKDIEKETAKDAGAEPPSMTQLLRR

SEQ ID NO: 40549 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKCGVSNKDIEKETAKDASGEPPSMTQLLRR

SEQ ID NO: 40550 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKCGVSNKDIEKETAKDASSEPPSMTQLLRR

SEQ ID NO: 40551 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKCGVSNKDIEKETAKDASAEPPSMTQLLRR

SEQ ID NO: 40552 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKCGVSNKDIEKETAKDAAGEPPSMTQLLRR

SEQ ID NO: 40553 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKCGVSNKDIEKETAKDAASEPPSMTQLLRR

SEQ ID NO: 40554 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKCGVSNKDIEKETAKDAAAEPPSMTQLLRR

SEQ ID NO: 40555 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKSGVSNKDIEKETAKDGGGEPPSMTQLLRR

SEQ ID NO: 40556 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKSGVSNKDIEKETAKDGGSEPPSMTQLLRR

SEQ ID NO: 40557 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKSGVSNKDIEKETAKDGGAEPPSMTQLLRR

SEQ ID NO: 40558 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKSGVSNKDIEKETAKDGSGEPPSMTQLLRR

SEQ ID NO: 40559 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKSGVSNKDIEKETAKDGSSEPPSMTQLLRR

SEQ ID NO: 40560 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKSGVSNKDIEKETAKDGSAEPPSMTQLLRR

SEQ ID NO: 40561 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKSGVSNKDIEKETAKDGAGEPPSMTQLLRR

SEQ ID NO: 40562 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKSGVSNKDIEKETAKDGASEPPSMTQLLRR

SEQ ID NO: 40563 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKSGVSNKDIEKETAKDGAAEPPSMTQLLRR

SEQ ID NO: 40564 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKSGVSNKDIEKETAKDSGGEPPSMTQLLRR

SEQ ID NO: 40565 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKSGVSNKDIEKETAKDSGSEPPSMTQLLRR

SEQ ID NO: 40566 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKSGVSNKDIEKETAKDSGAEPPSMTQLLRR

SEQ ID NO: 40567 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKSGVSNKDIEKETAKDSSGEPPSMTQLLRR

SEQ ID NO: 40568 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKSGVSNKDIEKETAKDSSSEPPSMTQLLRR

SEQ ID NO: 40569 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKSGVSNKDIEKETAKDSSAEPPSMTQLLRR

SEQ ID NO: 40570 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKSGVSNKDIEKETAKDSAGEPPSMTQLLRR

SEQ ID NO: 40571 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKSGVSNKDIEKETAKDSASEPPSMTQLLRR

SEQ ID NO: 40572 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKSGVSNKDIEKETAKDSAAEPPSMTQLLRR

SEQ ID NO: 40573 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKSGVSNKDIEKETAKDAGGEPPSMTQLLRR

SEQ ID NO: 40574 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKSGVSNKDIEKETAKDAGSEPPSMTQLLRR

SEQ ID NO: 40575 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKSGVSNKDIEKETAKDAGAEPPSMTQLLRR

SEQ ID NO: 40576 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKSGVSNKDIEKETAKDASGEPPSMTQLLRR

SEQ ID NO: 40577 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKSGVSNKDIEKETAKDASSEPPSMTQLLRR

SEQ ID NO: 40578 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKSGVSNKDIEKETAKDASAEPPSMTQLLRR

SEQ ID NO: 40579 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKSGVSNKDIEKETAKDAAGEPPSMTQLLRR

SEQ ID NO: 40580 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKSGVSNKDIEKETAKDAASEPPSMTQLLRR

SEQ ID NO: 40581 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKSGVSNKDIEKETAKDAAAEPPSMTQLLRR

SEQ ID NO: 40582 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKAGVSNKDIEKETAKDGGGEPPSMTQLLRR

SEQ ID NO: 40583 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKAGVSNKDIEKETAKDGGSEPPSMTQLLRR

SEQ ID NO: 40584 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKAGVSNKDIEKETAKDGGAEPPSMTQLLRR

SEQ ID NO: 40585 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKAGVSNKDIEKETAKDGSGEPPSMTQLLRR

SEQ ID NO: 40586 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKAGVSNKDIEKETAKDGSSEPPSMTQLLRR

SEQ ID NO: 40587 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKAGVSNKDIEKETAKDGSAEPPSMTQLLRR

SEQ ID NO: 40588 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKAGVSNKDIEKETAKDGAGEPPSMTQLLRR

SEQ ID NO: 40589 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKAGVSNKDIEKETAKDGASEPPSMTQLLRR

SEQ ID NO: 40590 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKAGVSNKDIEKETAKDGAAEPPSMTQLLRR

SEQ ID NO: 40591 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKAGVSNKDIEKETAKDSGGEPPSMTQLLRR

SEQ ID NO: 40592 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKAGVSNKDIEKETAKDSGSEPPSMTQLLRR

SEQ ID NO: 40593 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKAGVSNKDIEKETAKDSGAEPPSMTQLLRR

SEQ ID NO: 40594 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKAGVSNKDIEKETAKDSSGEPPSMTQLLRR

SEQ ID NO: 40595 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKAGVSNKDIEKETAKDSSSEPPSMTQLLRR

SEQ ID NO: 40596 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKAGVSNKDIEKETAKDSSAEPPSMTQLLRR

SEQ ID NO: 40597 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKAGVSNKDIEKETAKDSAGEPPSMTQLLRR

SEQ ID NO: 40598 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKAGVSNKDIEKETAKDSASEPPSMTQLLRR

SEQ ID NO: 40599 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKAGVSNKDIEKETAKDSAAEPPSMTQLLRR

SEQ ID NO: 40600 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKAGVSNKDIEKETAKDAGGEPPSMTQLLRR

SEQ ID NO: 40601 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKAGVSNKDIEKETAKDAGSEPPSMTQLLRR

SEQ ID NO: 40602 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKAGVSNKDIEKETAKDAGAEPPSMTQLLRR

SEQ ID NO: 40603 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKAGVSNKDIEKETAKDASGEPPSMTQLLRR

SEQ ID NO: 40604 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKAGVSNKDIEKETAKDASSEPPSMTQLLRR

SEQ ID NO: 40605 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKAGVSNKDIEKETAKDASAEPPSMTQLLRR

SEQ ID NO: 40606 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKAGVSNKDIEKETAKDAAGEPPSMTQLLRR

SEQ ID NO: 40607 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKAGVSNKDIEKETAKDAASEPPSMTQLLRR

SEQ ID NO: 40608 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKAGVSNKDIEKETAKDAAAEPPSMTQLLRR

SEQ ID NO: 40609 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKGGVSNKDIEKETAKDGGGEPPSMTQLLRR

SEQ ID NO: 40610 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKGGVSNKDIEKETAKDGGSEPPSMTQLLRR

SEQ ID NO: 40611 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKGGVSNKDIEKETAKDGGAEPPSMTQLLRR

SEQ ID NO: 40612 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKGGVSNKDIEKETAKDGSGEPPSMTQLLRR

SEQ ID NO: 40613 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKGGVSNKDIEKETAKDGSSEPPSMTQLLRR

SEQ ID NO: 40614 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKGGVSNKDIEKETAKDGSAEPPSMTQLLRR

SEQ ID NO: 40615 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKGGVSNKDIEKETAKDGAGEPPSMTQLLRR

SEQ ID NO: 40616 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKGGVSNKDIEKETAKDGASEPPSMTQLLRR

SEQ ID NO: 40617 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKGGVSNKDIEKETAKDGAAEPPSMTQLLRR

SEQ ID NO: 40618 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKGGVSNKDIEKETAKDSGGEPPSMTQLLRR

SEQ ID NO: 40619 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKGGVSNKDIEKETAKDSGSEPPSMTQLLRR

SEQ ID NO: 40620 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKGGVSNKDIEKETAKDSGAEPPSMTQLLRR

SEQ ID NO: 40621 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKGGVSNKDIEKETAKDSSGEPPSMTQLLRR

SEQ ID NO: 40622 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKGGVSNKDIEKETAKDSSSEPPSMTQLLRR

SEQ ID NO: 40623 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKGGVSNKDIEKETAKDSSAEPPSMTQLLRR

SEQ ID NO: 40624 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKGGVSNKDIEKETAKDSAGEPPSMTQLLRR

SEQ ID NO: 40625 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKGGVSNKDIEKETAKDSASEPPSMTQLLRR

SEQ ID NO: 40626 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKGGVSNKDIEKETAKDSAAEPPSMTQLLRR

SEQ ID NO: 40627 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKGGVSNKDIEKETAKDAGGEPPSMTQLLRR

SEQ ID NO: 40628 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKGGVSNKDIEKETAKDAGSEPPSMTQLLRR

SEQ ID NO: 40629 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKGGVSNKDIEKETAKDAGAEPPSMTQLLRR

SEQ ID NO: 40630 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKGGVSNKDIEKETAKDASGEPPSMTQLLRR

SEQ ID NO: 40631 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKGGVSNKDIEKETAKDASSEPPSMTQLLRR

SEQ ID NO: 40632 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKGGVSNKDIEKETAKDASAEPPSMTQLLRR

SEQ ID NO: 40633 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKGGVSNKDIEKETAKDAAGEPPSMTQLLRR

SEQ ID NO: 40634 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKGGVSNKDIEKETAKDAASEPPSMTQLLRR

SEQ ID NO: 40635 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKGGVSNKDIEKETAKDAAAEPPSMTQLLRR

SEQ ID NO: 40636 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKDGVSNKDIEKETAKDGGGEPPSMTQLLRR

SEQ ID NO: 40637 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKDGVSNKDIEKETAKDGGSEPPSMTQLLRR

SEQ ID NO: 40638 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKDGVSNKDIEKETAKDGGAEPPSMTQLLRR

SEQ ID NO: 40639 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKDGVSNKDIEKETAKDGSGEPPSMTQLLRR

SEQ ID NO: 40640 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKDGVSNKDIEKETAKDGSSEPPSMTQLLRR

SEQ ID NO: 40641 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKDGVSNKDIEKETAKDGSAEPPSMTQLLRR

SEQ ID NO: 40642 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKDGVSNKDIEKETAKDGAGEPPSMTQLLRR

SEQ ID NO: 40643 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKDGVSNKDIEKETAKDGASEPPSMTQLLRR

SEQ ID NO: 40644 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKDGVSNKDIEKETAKDGAAEPPSMTQLLRR

SEQ ID NO: 40645 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKDGVSNKDIEKETAKDSGGEPPSMTQLLRR

SEQ ID NO: 40646 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKDGVSNKDIEKETAKDSGSEPPSMTQLLRR

SEQ ID NO: 40647 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKDGVSNKDIEKETAKDSGAEPPSMTQLLRR

SEQ ID NO: 40648 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKDGVSNKDIEKETAKDSSGEPPSMTQLLRR

SEQ ID NO: 40649 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKDGVSNKDIEKETAKDSSSEPPSMTQLLRR

SEQ ID NO: 40650 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKDGVSNKDIEKETAKDSSAEPPSMTQLLRR

SEQ ID NO: 40651 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKDGVSNKDIEKETAKDSAGEPPSMTQLLRR

SEQ ID NO: 40652 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKDGVSNKDIEKETAKDSASEPPSMTQLLRR

SEQ ID NO: 40653 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKDGVSNKDIEKETAKDSAAEPPSMTQLLRR

SEQ ID NO: 40654 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKDGVSNKDIEKETAKDAGGEPPSMTQLLRR

SEQ ID NO: 40655 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKDGVSNKDIEKETAKDAGSEPPSMTQLLRR

SEQ ID NO: 40656 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKDGVSNKDIEKETAKDAGAEPPSMTQLLRR

SEQ ID NO: 40657 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKDGVSNKDIEKETAKDASGEPPSMTQLLRR

SEQ ID NO: 40658 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKDGVSNKDIEKETAKDASSEPPSMTQLLRR

SEQ ID NO: 40659 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKDGVSNKDIEKETAKDASAEPPSMTQLLRR

SEQ ID NO: 40660 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKDGVSNKDIEKETAKDAAGEPPSMTQLLRR

SEQ ID NO: 40661 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKDGVSNKDIEKETAKDAASEPPSMTQLLRR

SEQ ID NO: 40662 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKDGVSNKDIEKETAKDAAAEPPSMTQLLRR

SEQ ID NO: 40663 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKHGVSNKDIEKETAKDGGGEPPSMTQLLRR

SEQ ID NO: 40664 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKHGVSNKDIEKETAKDGGSEPPSMTQLLRR

SEQ ID NO: 40665 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKHGVSNKDIEKETAKDGGAEPPSMTQLLRR

SEQ ID NO: 40666 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKHGVSNKDIEKETAKDGSGEPPSMTQLLRR

SEQ ID NO: 40667 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKHGVSNKDIEKETAKDGSSEPPSMTQLLRR

SEQ ID NO: 40668 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKHGVSNKDIEKETAKDGSAEPPSMTQLLRR

SEQ ID NO: 40669 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKHGVSNKDIEKETAKDGAGEPPSMTQLLRR

SEQ ID NO: 40670 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKHGVSNKDIEKETAKDGASEPPSMTQLLRR

SEQ ID NO: 40671 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKHGVSNKDIEKETAKDGAAEPPSMTQLLRR

SEQ ID NO: 40672 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKHGVSNKDIEKETAKDSGGEPPSMTQLLRR

SEQ ID NO: 40673 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKHGVSNKDIEKETAKDSGSEPPSMTQLLRR

SEQ ID NO: 40674 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKHGVSNKDIEKETAKDSGAEPPSMTQLLRR

SEQ ID NO: 40675 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKHGVSNKDIEKETAKDSSGEPPSMTQLLRR

SEQ ID NO: 40676 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKHGVSNKDIEKETAKDSSSEPPSMTQLLRR

SEQ ID NO: 40677 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKHGVSNKDIEKETAKDSSAEPPSMTQLLRR

SEQ ID NO: 40678 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKHGVSNKDIEKETAKDSAGEPPSMTQLLRR

SEQ ID NO: 40679 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKHGVSNKDIEKETAKDSASEPPSMTQLLRR

SEQ ID NO: 40680 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKHGVSNKDIEKETAKDSAAEPPSMTQLLRR

SEQ ID NO: 40681 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKHGVSNKDIEKETAKDAGGEPPSMTQLLRR

SEQ ID NO: 40682 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKHGVSNKDIEKETAKDAGSEPPSMTQLLRR

SEQ ID NO: 40683 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKHGVSNKDIEKETAKDAGAEPPSMTQLLRR

SEQ ID NO: 40684 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKHGVSNKDIEKETAKDASGEPPSMTQLLRR

SEQ ID NO: 40685 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKHGVSNKDIEKETAKDASSEPPSMTQLLRR

SEQ ID NO: 40686 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKHGVSNKDIEKETAKDASAEPPSMTQLLRR

SEQ ID NO: 40687 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKHGVSNKDIEKETAKDAAGEPPSMTQLLRR

SEQ ID NO: 40688 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKHGVSNKDIEKETAKDAASEPPSMTQLLRR

SEQ ID NO: 40689 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKHGVSNKDIEKETAKDAAAEPPSMTQLLRR

SEQ ID NO: 40690 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKYGVSNKDIEKETAKDGGGEPPSMTQLLRR

SEQ ID NO: 40691 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKYGVSNKDIEKETAKDGGSEPPSMTQLLRR

SEQ ID NO: 40692 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKYGVSNKDIEKETAKDGGAEPPSMTQLLRR

SEQ ID NO: 40693 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKYGVSNKDIEKETAKDGSGEPPSMTQLLRR

SEQ ID NO: 40694 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKYGVSNKDIEKETAKDGSSEPPSMTQLLRR

SEQ ID NO: 40695 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKYGVSNKDIEKETAKDGSAEPPSMTQLLRR

SEQ ID NO: 40696 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKYGVSNKDIEKETAKDGAGEPPSMTQLLRR

SEQ ID NO: 40697 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKYGVSNKDIEKETAKDGASEPPSMTQLLRR

SEQ ID NO: 40698 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKYGVSNKDIEKETAKDGAAEPPSMTQLLRR

SEQ ID NO: 40699 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKYGVSNKDIEKETAKDSGGEPPSMTQLLRR

SEQ ID NO: 40700 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKYGVSNKDIEKETAKDSGSEPPSMTQLLRR

SEQ ID NO: 40701 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKYGVSNKDIEKETAKDSGAEPPSMTQLLRR

SEQ ID NO: 40702 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKYGVSNKDIEKETAKDSSGEPPSMTQLLRR

SEQ ID NO: 40703 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKYGVSNKDIEKETAKDSSSEPPSMTQLLRR

SEQ ID NO: 40704 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKYGVSNKDIEKETAKDSSAEPPSMTQLLRR

SEQ ID NO: 40705 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKYGVSNKDIEKETAKDSAGEPPSMTQLLRR

SEQ ID NO: 40706 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKYGVSNKDIEKETAKDSASEPPSMTQLLRR

SEQ ID NO: 40707 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKYGVSNKDIEKETAKDSAAEPPSMTQLLRR

SEQ ID NO: 40708 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKYGVSNKDIEKETAKDAGGEPPSMTQLLRR

SEQ ID NO: 40709 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKYGVSNKDIEKETAKDAGSEPPSMTQLLRR

SEQ ID NO: 40710 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKYGVSNKDIEKETAKDAGAEPPSMTQLLRR

SEQ ID NO: 40711 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKYGVSNKDIEKETAKDASGEPPSMTQLLRR

SEQ ID NO: 40712 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKYGVSNKDIEKETAKDASSEPPSMTQLLRR

SEQ ID NO: 40713 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKYGVSNKDIEKETAKDASAEPPSMTQLLRR

SEQ ID NO: 40714 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKYGVSNKDIEKETAKDAAGEPPSMTQLLRR

SEQ ID NO: 40715 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKYGVSNKDIEKETAKDAASEPPSMTQLLRR

SEQ ID NO: 40716 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKYGVSNKDIEKETAKDAAAEPPSMTQLLRR

SEQ ID NO: 40717 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKKGVSNKDIEKETAKDGGGEPPSMTQLLRR

SEQ ID NO: 40718 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKKGVSNKDIEKETAKDGGSEPPSMTQLLRR

SEQ ID NO: 40719 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKKGVSNKDIEKETAKDGGAEPPSMTQLLRR

SEQ ID NO: 40720 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKKGVSNKDIEKETAKDGSGEPPSMTQLLRR

SEQ ID NO: 40721 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKKGVSNKDIEKETAKDGSSEPPSMTQLLRR

SEQ ID NO: 40722 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKKGVSNKDIEKETAKDGSAEPPSMTQLLRR

SEQ ID NO: 40723 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKKGVSNKDIEKETAKDGAGEPPSMTQLLRR

SEQ ID NO: 40724 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKKGVSNKDIEKETAKDGASEPPSMTQLLRR

SEQ ID NO: 40725 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKKGVSNKDIEKETAKDGAAEPPSMTQLLRR

SEQ ID NO: 40726 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKKGVSNKDIEKETAKDSGGEPPSMTQLLRR

SEQ ID NO: 40727 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKKGVSNKDIEKETAKDSGSEPPSMTQLLRR

SEQ ID NO: 40728 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKKGVSNKDIEKETAKDSGAEPPSMTQLLRR

SEQ ID NO: 40729 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKKGVSNKDIEKETAKDSSGEPPSMTQLLRR

SEQ ID NO: 40730 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKKGVSNKDIEKETAKDSSSEPPSMTQLLRR

SEQ ID NO: 40731 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKKGVSNKDIEKETAKDSSAEPPSMTQLLRR

SEQ ID NO: 40732 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKKGVSNKDIEKETAKDSAGEPPSMTQLLRR

SEQ ID NO: 40733 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKKGVSNKDIEKETAKDSASEPPSMTQLLRR

SEQ ID NO: 40734 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKKGVSNKDIEKETAKDSAAEPPSMTQLLRR

SEQ ID NO: 40735 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKKGVSNKDIEKETAKDAGGEPPSMTQLLRR

SEQ ID NO: 40736 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKKGVSNKDIEKETAKDAGSEPPSMTQLLRR

SEQ ID NO: 40737 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKKGVSNKDIEKETAKDAGAEPPSMTQLLRR

SEQ ID NO: 40738 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKKGVSNKDIEKETAKDASGEPPSMTQLLRR

SEQ ID NO: 40739 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKKGVSNKDIEKETAKDASSEPPSMTQLLRR

SEQ ID NO: 40740 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKKGVSNKDIEKETAKDASAEPPSMTQLLRR

SEQ ID NO: 40741 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKKGVSNKDIEKETAKDAAGEPPSMTQLLRR

SEQ ID NO: 40742 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKKGVSNKDIEKETAKDAASEPPSMTQLLRR

SEQ ID NO: 40743 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKKGVSNKDIEKETAKDAAAEPPSMTQLLRR

SEQ ID NO: 40744 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKNGVSNKDIEKETAKDGGGEPPSMTQLLRR

SEQ ID NO: 40745 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKNGVSNKDIEKETAKDGGSEPPSMTQLLRR

SEQ ID NO: 40746 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKNGVSNKDIEKETAKDGGAEPPSMTQLLRR

SEQ ID NO: 40747 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKNGVSNKDIEKETAKDGSGEPPSMTQLLRR

SEQ ID NO: 40748 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKNGVSNKDIEKETAKDGSSEPPSMTQLLRR

SEQ ID NO: 40749 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKNGVSNKDIEKETAKDGSAEPPSMTQLLRR

SEQ ID NO: 40750 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKNGVSNKDIEKETAKDGAGEPPSMTQLLRR

SEQ ID NO: 40751 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKNGVSNKDIEKETAKDGASEPPSMTQLLRR

SEQ ID NO: 40752 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKNGVSNKDIEKETAKDGAAEPPSMTQLLRR

SEQ ID NO: 40753 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKNGVSNKDIEKETAKDSGGEPPSMTQLLRR

SEQ ID NO: 40754 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKNGVSNKDIEKETAKDSGSEPPSMTQLLRR

SEQ ID NO: 40755 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKNGVSNKDIEKETAKDSGAEPPSMTQLLRR

SEQ ID NO: 40756 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKNGVSNKDIEKETAKDSSGEPPSMTQLLRR

SEQ ID NO: 40757 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKNGVSNKDIEKETAKDSSSEPPSMTQLLRR

SEQ ID NO: 40758 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKNGVSNKDIEKETAKDSSAEPPSMTQLLRR

SEQ ID NO: 40759 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKNGVSNKDIEKETAKDSAGEPPSMTQLLRR

SEQ ID NO: 40760 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKNGVSNKDIEKETAKDSASEPPSMTQLLRR

SEQ ID NO: 40761 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKNGVSNKDIEKETAKDSAAEPPSMTQLLRR

SEQ ID NO: 40762 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKNGVSNKDIEKETAKDAGGEPPSMTQLLRR

SEQ ID NO: 40763 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKNGVSNKDIEKETAKDAGSEPPSMTQLLRR

SEQ ID NO: 40764 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKNGVSNKDIEKETAKDAGAEPPSMTQLLRR

SEQ ID NO: 40765 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKNGVSNKDIEKETAKDASGEPPSMTQLLRR

SEQ ID NO: 40766 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKNGVSNKDIEKETAKDASSEPPSMTQLLRR

SEQ ID NO: 40767 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKNGVSNKDIEKETAKDASAEPPSMTQLLRR

SEQ ID NO: 40768 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKNGVSNKDIEKETAKDAAGEPPSMTQLLRR

SEQ ID NO: 40769 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKNGVSNKDIEKETAKDAASEPPSMTQLLRR

SEQ ID NO: 40770 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKNGVSNKDIEKETAKDAAAEPPSMTQLLRR

SEQ ID NO: 40771 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKMGVSNKDIEKETAKDGGGEPPSMTQLLRR

SEQ ID NO: 40772 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKMGVSNKDIEKETAKDGGSEPPSMTQLLRR

SEQ ID NO: 40773 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKMGVSNKDIEKETAKDGGAEPPSMTQLLRR

SEQ ID NO: 40774 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKMGVSNKDIEKETAKDGSGEPPSMTQLLRR

SEQ ID NO: 40775 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKMGVSNKDIEKETAKDGSSEPPSMTQLLRR

SEQ ID NO: 40776 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKMGVSNKDIEKETAKDGSAEPPSMTQLLRR

SEQ ID NO: 40777 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKMGVSNKDIEKETAKDGAGEPPSMTQLLRR

SEQ ID NO: 40778 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKMGVSNKDIEKETAKDGASEPPSMTQLLRR

SEQ ID NO: 40779 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKMGVSNKDIEKETAKDGAAEPPSMTQLLRR

SEQ ID NO: 40780 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKMGVSNKDIEKETAKDSGGEPPSMTQLLRR

SEQ ID NO: 40781 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKMGVSNKDIEKETAKDSGSEPPSMTQLLRR

SEQ ID NO: 40782 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKMGVSNKDIEKETAKDSGAEPPSMTQLLRR

SEQ ID NO: 40783 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKMGVSNKDIEKETAKDSSGEPPSMTQLLRR

SEQ ID NO: 40784 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKMGVSNKDIEKETAKDSSSEPPSMTQLLRR

SEQ ID NO: 40785 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKMGVSNKDIEKETAKDSSAEPPSMTQLLRR

SEQ ID NO: 40786 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKMGVSNKDIEKETAKDSAGEPPSMTQLLRR

SEQ ID NO: 40787 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKMGVSNKDIEKETAKDSASEPPSMTQLLRR

SEQ ID NO: 40788 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKMGVSNKDIEKETAKDSAAEPPSMTQLLRR

SEQ ID NO: 40789 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKMGVSNKDIEKETAKDAGGEPPSMTQLLRR

SEQ ID NO: 40790 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKMGVSNKDIEKETAKDAGSEPPSMTQLLRR

SEQ ID NO: 40791 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKMGVSNKDIEKETAKDAGAEPPSMTQLLRR

SEQ ID NO: 40792 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKMGVSNKDIEKETAKDASGEPPSMTQLLRR

SEQ ID NO: 40793 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKMGVSNKDIEKETAKDASSEPPSMTQLLRR

SEQ ID NO: 40794 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKMGVSNKDIEKETAKDASAEPPSMTQLLRR

SEQ ID NO: 40795 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKMGVSNKDIEKETAKDAAGEPPSMTQLLRR

SEQ ID NO: 40796 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKMGVSNKDIEKETAKDAASEPPSMTQLLRR

SEQ ID NO: 40797 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKMGVSNKDIEKETAKDAAAEPPSMTQLLRR

SEQ ID NO: 40798 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKCGVSNKDIEKETAKDGGGEPPSMTQLLRR

SEQ ID NO: 40799 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKCGVSNKDIEKETAKDGGSEPPSMTQLLRR

SEQ ID NO: 40800 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKCGVSNKDIEKETAKDGGAEPPSMTQLLRR

SEQ ID NO: 40801 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKCGVSNKDIEKETAKDGSGEPPSMTQLLRR

SEQ ID NO: 40802 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKCGVSNKDIEKETAKDGSSEPPSMTQLLRR

SEQ ID NO: 40803 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKCGVSNKDIEKETAKDGSAEPPSMTQLLRR

SEQ ID NO: 40804 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKCGVSNKDIEKETAKDGAGEPPSMTQLLRR

SEQ ID NO: 40805 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKCGVSNKDIEKETAKDGASEPPSMTQLLRR

SEQ ID NO: 40806 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKCGVSNKDIEKETAKDGAAEPPSMTQLLRR

SEQ ID NO: 40807 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKCGVSNKDIEKETAKDSGGEPPSMTQLLRR

SEQ ID NO: 40808 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKCGVSNKDIEKETAKDSGSEPPSMTQLLRR

SEQ ID NO: 40809 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKCGVSNKDIEKETAKDSGAEPPSMTQLLRR

SEQ ID NO: 40810 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKCGVSNKDIEKETAKDSSGEPPSMTQLLRR

SEQ ID NO: 40811 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKCGVSNKDIEKETAKDSSSEPPSMTQLLRR

SEQ ID NO: 40812 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKCGVSNKDIEKETAKDSSAEPPSMTQLLRR

SEQ ID NO: 40813 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKCGVSNKDIEKETAKDSAGEPPSMTQLLRR

SEQ ID NO: 40814 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKCGVSNKDIEKETAKDSASEPPSMTQLLRR

SEQ ID NO: 40815 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKCGVSNKDIEKETAKDSAAEPPSMTQLLRR

SEQ ID NO: 40816 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKCGVSNKDIEKETAKDAGGEPPSMTQLLRR

SEQ ID NO: 40817 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKCGVSNKDIEKETAKDAGSEPPSMTQLLRR

SEQ ID NO: 40818 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKCGVSNKDIEKETAKDAGAEPPSMTQLLRR

SEQ ID NO: 40819 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKCGVSNKDIEKETAKDASGEPPSMTQLLRR

SEQ ID NO: 40820 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKCGVSNKDIEKETAKDASSEPPSMTQLLRR

SEQ ID NO: 40821 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKCGVSNKDIEKETAKDASAEPPSMTQLLRR

SEQ ID NO: 40822 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKCGVSNKDIEKETAKDAAGEPPSMTQLLRR

SEQ ID NO: 40823 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKCGVSNKDIEKETAKDAASEPPSMTQLLRR

SEQ ID NO: 40824 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKCGVSNKDIEKETAKDAAAEPPSMTQLLRR

SEQ ID NO: 40825 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKSGVSNKDIEKETAKDGGGEPPSMTQLLRR

SEQ ID NO: 40826 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKSGVSNKDIEKETAKDGGSEPPSMTQLLRR

SEQ ID NO: 40827 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKSGVSNKDIEKETAKDGGAEPPSMTQLLRR

SEQ ID NO: 40828 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKSGVSNKDIEKETAKDGSGEPPSMTQLLRR

SEQ ID NO: 40829 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKSGVSNKDIEKETAKDGSSEPPSMTQLLRR

SEQ ID NO: 40830 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKSGVSNKDIEKETAKDGSAEPPSMTQLLRR

SEQ ID NO: 40831 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKSGVSNKDIEKETAKDGAGEPPSMTQLLRR

SEQ ID NO: 40832 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKSGVSNKDIEKETAKDGASEPPSMTQLLRR

SEQ ID NO: 40833 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKSGVSNKDIEKETAKDGAAEPPSMTQLLRR

SEQ ID NO: 40834 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKSGVSNKDIEKETAKDSGGEPPSMTQLLRR

SEQ ID NO: 40835 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKSGVSNKDIEKETAKDSGSEPPSMTQLLRR

SEQ ID NO: 40836 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKSGVSNKDIEKETAKDSGAEPPSMTQLLRR

SEQ ID NO: 40837 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKSGVSNKDIEKETAKDSSGEPPSMTQLLRR

SEQ ID NO: 40838 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKSGVSNKDIEKETAKDSSSEPPSMTQLLRR

SEQ ID NO: 40839 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKSGVSNKDIEKETAKDSSAEPPSMTQLLRR

SEQ ID NO: 40840 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKSGVSNKDIEKETAKDSAGEPPSMTQLLRR

SEQ ID NO: 40841 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKSGVSNKDIEKETAKDSASEPPSMTQLLRR

SEQ ID NO: 40842 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKSGVSNKDIEKETAKDSAAEPPSMTQLLRR

SEQ ID NO: 40843 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKSGVSNKDIEKETAKDAGGEPPSMTQLLRR

SEQ ID NO: 40844 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKSGVSNKDIEKETAKDAGSEPPSMTQLLRR

SEQ ID NO: 40845 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKSGVSNKDIEKETAKDAGAEPPSMTQLLRR

SEQ ID NO: 40846 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKSGVSNKDIEKETAKDASGEPPSMTQLLRR

SEQ ID NO: 40847 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKSGVSNKDIEKETAKDASSEPPSMTQLLRR

SEQ ID NO: 40848 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKSGVSNKDIEKETAKDASAEPPSMTQLLRR

SEQ ID NO: 40849 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKSGVSNKDIEKETAKDAAGEPPSMTQLLRR

SEQ ID NO: 40850 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKSGVSNKDIEKETAKDAASEPPSMTQLLRR

SEQ ID NO: 40851 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKSGVSNKDIEKETAKDAAAEPPSMTQLLRR

SEQ ID NO: 40852 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKAGVSNKDIEKETAKDGGGEPPSMTQLLRR

SEQ ID NO: 40853 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKAGVSNKDIEKETAKDGGSEPPSMTQLLRR

SEQ ID NO: 40854 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKAGVSNKDIEKETAKDGGAEPPSMTQLLRR

SEQ ID NO: 40855 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKAGVSNKDIEKETAKDGSGEPPSMTQLLRR

SEQ ID NO: 40856 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKAGVSNKDIEKETAKDGSSEPPSMTQLLRR

SEQ ID NO: 40857 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKAGVSNKDIEKETAKDGSAEPPSMTQLLRR

SEQ ID NO: 40858 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKAGVSNKDIEKETAKDGAGEPPSMTQLLRR

SEQ ID NO: 40859 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKAGVSNKDIEKETAKDGASEPPSMTQLLRR

SEQ ID NO: 40860 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKAGVSNKDIEKETAKDGAAEPPSMTQLLRR

SEQ ID NO: 40861 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKAGVSNKDIEKETAKDSGGEPPSMTQLLRR

SEQ ID NO: 40862 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKAGVSNKDIEKETAKDSGSEPPSMTQLLRR

SEQ ID NO: 40863 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKAGVSNKDIEKETAKDSGAEPPSMTQLLRR

SEQ ID NO: 40864 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKAGVSNKDIEKETAKDSSGEPPSMTQLLRR

SEQ ID NO: 40865 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKAGVSNKDIEKETAKDSSSEPPSMTQLLRR

SEQ ID NO: 40866 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKAGVSNKDIEKETAKDSSAEPPSMTQLLRR

SEQ ID NO: 40867 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKAGVSNKDIEKETAKDSAGEPPSMTQLLRR

SEQ ID NO: 40868 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKAGVSNKDIEKETAKDSASEPPSMTQLLRR

SEQ ID NO: 40869 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKAGVSNKDIEKETAKDSAAEPPSMTQLLRR

SEQ ID NO: 40870 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKAGVSNKDIEKETAKDAGGEPPSMTQLLRR

SEQ ID NO: 40871 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKAGVSNKDIEKETAKDAGSEPPSMTQLLRR

SEQ ID NO: 40872 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKAGVSNKDIEKETAKDAGAEPPSMTQLLRR

SEQ ID NO: 40873 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKAGVSNKDIEKETAKDASGEPPSMTQLLRR

SEQ ID NO: 40874 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKAGVSNKDIEKETAKDASSEPPSMTQLLRR

SEQ ID NO: 40875 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKAGVSNKDIEKETAKDASAEPPSMTQLLRR

SEQ ID NO: 40876 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKAGVSNKDIEKETAKDAAGEPPSMTQLLRR

SEQ ID NO: 40877 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKAGVSNKDIEKETAKDAASEPPSMTQLLRR

SEQ ID NO: 40878 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKAGVSNKDIEKETAKDAAAEPPSMTQLLRR

SEQ ID NO: 40879 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKGGVSNKDIEKETAKDGGGEPPSMTQLLRR

SEQ ID NO: 40880 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKGGVSNKDIEKETAKDGGSEPPSMTQLLRR

SEQ ID NO: 40881 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKGGVSNKDIEKETAKDGGAEPPSMTQLLRR

SEQ ID NO: 40882 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKGGVSNKDIEKETAKDGSGEPPSMTQLLRR

SEQ ID NO: 40883 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKGGVSNKDIEKETAKDGSSEPPSMTQLLRR

SEQ ID NO: 40884 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKGGVSNKDIEKETAKDGSAEPPSMTQLLRR

SEQ ID NO: 40885 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKGGVSNKDIEKETAKDGAGEPPSMTQLLRR

SEQ ID NO: 40886 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKGGVSNKDIEKETAKDGASEPPSMTQLLRR

SEQ ID NO: 40887 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKGGVSNKDIEKETAKDGAAEPPSMTQLLRR

SEQ ID NO: 40888 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKGGVSNKDIEKETAKDSGGEPPSMTQLLRR

SEQ ID NO: 40889 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKGGVSNKDIEKETAKDSGSEPPSMTQLLRR

SEQ ID NO: 40890 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKGGVSNKDIEKETAKDSGAEPPSMTQLLRR

SEQ ID NO: 40891 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKGGVSNKDIEKETAKDSSGEPPSMTQLLRR

SEQ ID NO: 40892 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKGGVSNKDIEKETAKDSSSEPPSMTQLLRR

SEQ ID NO: 40893 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKGGVSNKDIEKETAKDSSAEPPSMTQLLRR

SEQ ID NO: 40894 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKGGVSNKDIEKETAKDSAGEPPSMTQLLRR

SEQ ID NO: 40895 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKGGVSNKDIEKETAKDSASEPPSMTQLLRR

SEQ ID NO: 40896 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKGGVSNKDIEKETAKDSAAEPPSMTQLLRR

SEQ ID NO: 40897 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKGGVSNKDIEKETAKDAGGEPPSMTQLLRR

SEQ ID NO: 40898 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKGGVSNKDIEKETAKDAGSEPPSMTQLLRR

SEQ ID NO: 40899 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKGGVSNKDIEKETAKDAGAEPPSMTQLLRR

SEQ ID NO: 40900 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKGGVSNKDIEKETAKDASGEPPSMTQLLRR

SEQ ID NO: 40901 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKGGVSNKDIEKETAKDASSEPPSMTQLLRR

SEQ ID NO: 40902 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKGGVSNKDIEKETAKDASAEPPSMTQLLRR

SEQ ID NO: 40903 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKGGVSNKDIEKETAKDAAGEPPSMTQLLRR

SEQ ID NO: 40904 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKGGVSNKDIEKETAKDAASEPPSMTQLLRR

SEQ ID NO: 40905 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKGGVSNKDIEKETAKDAAAEPPSMTQLLRR

SEQ ID NO: 40906 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKDGVSNKDIEKETAKDGGGEPPSMTQLLRR

SEQ ID NO: 40907 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKDGVSNKDIEKETAKDGGSEPPSMTQLLRR

SEQ ID NO: 40908 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKDGVSNKDIEKETAKDGGAEPPSMTQLLRR

SEQ ID NO: 40909 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKDGVSNKDIEKETAKDGSGEPPSMTQLLRR

SEQ ID NO: 40910 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKDGVSNKDIEKETAKDGSSEPPSMTQLLRR

SEQ ID NO: 40911 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKDGVSNKDIEKETAKDGSAEPPSMTQLLRR

SEQ ID NO: 40912 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKDGVSNKDIEKETAKDGAGEPPSMTQLLRR

SEQ ID NO: 40913 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKDGVSNKDIEKETAKDGASEPPSMTQLLRR

SEQ ID NO: 40914 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKDGVSNKDIEKETAKDGAAEPPSMTQLLRR

SEQ ID NO: 40915 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKDGVSNKDIEKETAKDSGGEPPSMTQLLRR

SEQ ID NO: 40916 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKDGVSNKDIEKETAKDSGSEPPSMTQLLRR

SEQ ID NO: 40917 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKDGVSNKDIEKETAKDSGAEPPSMTQLLRR

SEQ ID NO: 40918 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKDGVSNKDIEKETAKDSSGEPPSMTQLLRR

SEQ ID NO: 40919 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKDGVSNKDIEKETAKDSSSEPPSMTQLLRR

SEQ ID NO: 40920 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKDGVSNKDIEKETAKDSSAEPPSMTQLLRR

SEQ ID NO: 40921 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKDGVSNKDIEKETAKDSAGEPPSMTQLLRR

SEQ ID NO: 40922 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKDGVSNKDIEKETAKDSASEPPSMTQLLRR

SEQ ID NO: 40923 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKDGVSNKDIEKETAKDSAAEPPSMTQLLRR

SEQ ID NO: 40924 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKDGVSNKDIEKETAKDAGGEPPSMTQLLRR

SEQ ID NO: 40925 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKDGVSNKDIEKETAKDAGSEPPSMTQLLRR

SEQ ID NO: 40926 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKDGVSNKDIEKETAKDAGAEPPSMTQLLRR

SEQ ID NO: 40927 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKDGVSNKDIEKETAKDASGEPPSMTQLLRR

SEQ ID NO: 40928 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKDGVSNKDIEKETAKDASSEPPSMTQLLRR

SEQ ID NO: 40929 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKDGVSNKDIEKETAKDASAEPPSMTQLLRR

SEQ ID NO: 40930 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKDGVSNKDIEKETAKDAAGEPPSMTQLLRR

SEQ ID NO: 40931 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKDGVSNKDIEKETAKDAASEPPSMTQLLRR

SEQ ID NO: 40932 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKDGVSNKDIEKETAKDAAAEPPSMTQLLRR

SEQ ID NO: 40933 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKHGVSNKDIEKETAKDGGGEPPSMTQLLRR

SEQ ID NO: 40934 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKHGVSNKDIEKETAKDGGSEPPSMTQLLRR

SEQ ID NO: 40935 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKHGVSNKDIEKETAKDGGAEPPSMTQLLRR

SEQ ID NO: 40936 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKHGVSNKDIEKETAKDGSGEPPSMTQLLRR

SEQ ID NO: 40937 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKHGVSNKDIEKETAKDGSSEPPSMTQLLRR

SEQ ID NO: 40938 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKHGVSNKDIEKETAKDGSAEPPSMTQLLRR

SEQ ID NO: 40939 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKHGVSNKDIEKETAKDGAGEPPSMTQLLRR

SEQ ID NO: 40940 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKHGVSNKDIEKETAKDGASEPPSMTQLLRR

SEQ ID NO: 40941 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKHGVSNKDIEKETAKDGAAEPPSMTQLLRR

SEQ ID NO: 40942 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKHGVSNKDIEKETAKDSGGEPPSMTQLLRR

SEQ ID NO: 40943 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKHGVSNKDIEKETAKDSGSEPPSMTQLLRR

SEQ ID NO: 40944 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKHGVSNKDIEKETAKDSGAEPPSMTQLLRR

SEQ ID NO: 40945 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKHGVSNKDIEKETAKDSSGEPPSMTQLLRR

SEQ ID NO: 40946 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKHGVSNKDIEKETAKDSSSEPPSMTQLLRR

SEQ ID NO: 40947 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKHGVSNKDIEKETAKDSSAEPPSMTQLLRR

SEQ ID NO: 40948 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKHGVSNKDIEKETAKDSAGEPPSMTQLLRR

SEQ ID NO: 40949 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKHGVSNKDIEKETAKDSASEPPSMTQLLRR

SEQ ID NO: 40950 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKHGVSNKDIEKETAKDSAAEPPSMTQLLRR

SEQ ID NO: 40951 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKHGVSNKDIEKETAKDAGGEPPSMTQLLRR

SEQ ID NO: 40952 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKHGVSNKDIEKETAKDAGSEPPSMTQLLRR

SEQ ID NO: 40953 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKHGVSNKDIEKETAKDAGAEPPSMTQLLRR

SEQ ID NO: 40954 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKHGVSNKDIEKETAKDASGEPPSMTQLLRR

SEQ ID NO: 40955 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKHGVSNKDIEKETAKDASSEPPSMTQLLRR

SEQ ID NO: 40956 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKHGVSNKDIEKETAKDASAEPPSMTQLLRR

SEQ ID NO: 40957 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKHGVSNKDIEKETAKDAAGEPPSMTQLLRR

SEQ ID NO: 40958 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKHGVSNKDIEKETAKDAASEPPSMTQLLRR

SEQ ID NO: 40959 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKHGVSNKDIEKETAKDAAAEPPSMTQLLRR

SEQ ID NO: 40960 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKYGVSNKDIEKETAKDGGGEPPSMTQLLRR

SEQ ID NO: 40961 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKYGVSNKDIEKETAKDGGSEPPSMTQLLRR

SEQ ID NO: 40962 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKYGVSNKDIEKETAKDGGAEPPSMTQLLRR

SEQ ID NO: 40963 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKYGVSNKDIEKETAKDGSGEPPSMTQLLRR

SEQ ID NO: 40964 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKYGVSNKDIEKETAKDGSSEPPSMTQLLRR

SEQ ID NO: 40965 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKYGVSNKDIEKETAKDGSAEPPSMTQLLRR

SEQ ID NO: 40966 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKYGVSNKDIEKETAKDGAGEPPSMTQLLRR

SEQ ID NO: 40967 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKYGVSNKDIEKETAKDGASEPPSMTQLLRR

SEQ ID NO: 40968 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKYGVSNKDIEKETAKDGAAEPPSMTQLLRR

SEQ ID NO: 40969 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKYGVSNKDIEKETAKDSGGEPPSMTQLLRR

SEQ ID NO: 40970 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKYGVSNKDIEKETAKDSGSEPPSMTQLLRR

SEQ ID NO: 40971 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKYGVSNKDIEKETAKDSGAEPPSMTQLLRR

SEQ ID NO: 40972 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKYGVSNKDIEKETAKDSSGEPPSMTQLLRR

SEQ ID NO: 40973 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKYGVSNKDIEKETAKDSSSEPPSMTQLLRR

SEQ ID NO: 40974 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKYGVSNKDIEKETAKDSSAEPPSMTQLLRR

SEQ ID NO: 40975 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKYGVSNKDIEKETAKDSAGEPPSMTQLLRR

SEQ ID NO: 40976 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKYGVSNKDIEKETAKDSASEPPSMTQLLRR

SEQ ID NO: 40977 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKYGVSNKDIEKETAKDSAAEPPSMTQLLRR

SEQ ID NO: 40978 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKYGVSNKDIEKETAKDAGGEPPSMTQLLRR

SEQ ID NO: 40979 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKYGVSNKDIEKETAKDAGSEPPSMTQLLRR

SEQ ID NO: 40980 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKYGVSNKDIEKETAKDAGAEPPSMTQLLRR

SEQ ID NO: 40981 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKYGVSNKDIEKETAKDASGEPPSMTQLLRR

SEQ ID NO: 40982 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKYGVSNKDIEKETAKDASSEPPSMTQLLRR

SEQ ID NO: 40983 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKYGVSNKDIEKETAKDASAEPPSMTQLLRR

SEQ ID NO: 40984 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKYGVSNKDIEKETAKDAAGEPPSMTQLLRR

SEQ ID NO: 40985 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKYGVSNKDIEKETAKDAASEPPSMTQLLRR

SEQ ID NO: 40986 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKYGVSNKDIEKETAKDAAAEPPSMTQLLRR

SEQ ID NO: 40987 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKKGVSNKDIEKETAKDGGGEPPSMTQLLRR

SEQ ID NO: 40988 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKKGVSNKDIEKETAKDGGSEPPSMTQLLRR

SEQ ID NO: 40989 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKKGVSNKDIEKETAKDGGAEPPSMTQLLRR

SEQ ID NO: 40990 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKKGVSNKDIEKETAKDGSGEPPSMTQLLRR

SEQ ID NO: 40991 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKKGVSNKDIEKETAKDGSSEPPSMTQLLRR

SEQ ID NO: 40992 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKKGVSNKDIEKETAKDGSAEPPSMTQLLRR

SEQ ID NO: 40993 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKKGVSNKDIEKETAKDGAGEPPSMTQLLRR

SEQ ID NO: 40994 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKKGVSNKDIEKETAKDGASEPPSMTQLLRR

SEQ ID NO: 40995 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKKGVSNKDIEKETAKDGAAEPPSMTQLLRR

SEQ ID NO: 40996 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKKGVSNKDIEKETAKDSGGEPPSMTQLLRR

SEQ ID NO: 40997 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKKGVSNKDIEKETAKDSGSEPPSMTQLLRR

SEQ ID NO: 40998 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKKGVSNKDIEKETAKDSGAEPPSMTQLLRR

SEQ ID NO: 40999 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKKGVSNKDIEKETAKDSSGEPPSMTQLLRR

SEQ ID NO: 41000 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKKGVSNKDIEKETAKDSSSEPPSMTQLLRR

SEQ ID NO: 41001 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKKGVSNKDIEKETAKDSSAEPPSMTQLLRR

SEQ ID NO: 41002 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKKGVSNKDIEKETAKDSAGEPPSMTQLLRR

SEQ ID NO: 41003 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKKGVSNKDIEKETAKDSASEPPSMTQLLRR

SEQ ID NO: 41004 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKKGVSNKDIEKETAKDSAAEPPSMTQLLRR

SEQ ID NO: 41005 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKKGVSNKDIEKETAKDAGGEPPSMTQLLRR

SEQ ID NO: 41006 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKKGVSNKDIEKETAKDAGSEPPSMTQLLRR

SEQ ID NO: 41007 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKKGVSNKDIEKETAKDAGAEPPSMTQLLRR

SEQ ID NO: 41008 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKKGVSNKDIEKETAKDASGEPPSMTQLLRR

SEQ ID NO: 41009 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKKGVSNKDIEKETAKDASSEPPSMTQLLRR

SEQ ID NO: 41010 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKKGVSNKDIEKETAKDASAEPPSMTQLLRR

SEQ ID NO: 41011 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKKGVSNKDIEKETAKDAAGEPPSMTQLLRR

SEQ ID NO: 41012 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKKGVSNKDIEKETAKDAASEPPSMTQLLRR

SEQ ID NO: 41013 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKKGVSNKDIEKETAKDAAAEPPSMTQLLRR

SEQ ID NO: 41014 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKNGVSNKDIEKETAKDGGGEPPSMTQLLRR

SEQ ID NO: 41015 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKNGVSNKDIEKETAKDGGSEPPSMTQLLRR

SEQ ID NO: 41016 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKNGVSNKDIEKETAKDGGAEPPSMTQLLRR

SEQ ID NO: 41017 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKNGVSNKDIEKETAKDGSGEPPSMTQLLRR

SEQ ID NO: 41018 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKNGVSNKDIEKETAKDGSSEPPSMTQLLRR

SEQ ID NO: 41019 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKNGVSNKDIEKETAKDGSAEPPSMTQLLRR

SEQ ID NO: 41020 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKNGVSNKDIEKETAKDGAGEPPSMTQLLRR

SEQ ID NO: 41021 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKNGVSNKDIEKETAKDGASEPPSMTQLLRR

SEQ ID NO: 41022 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKNGVSNKDIEKETAKDGAAEPPSMTQLLRR

SEQ ID NO: 41023 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKNGVSNKDIEKETAKDSGGEPPSMTQLLRR

SEQ ID NO: 41024 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKNGVSNKDIEKETAKDSGSEPPSMTQLLRR

SEQ ID NO: 41025 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKNGVSNKDIEKETAKDSGAEPPSMTQLLRR

SEQ ID NO: 41026 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKNGVSNKDIEKETAKDSSGEPPSMTQLLRR

SEQ ID NO: 41027 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKNGVSNKDIEKETAKDSSSEPPSMTQLLRR

SEQ ID NO: 41028 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKNGVSNKDIEKETAKDSSAEPPSMTQLLRR

SEQ ID NO: 41029 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKNGVSNKDIEKETAKDSAGEPPSMTQLLRR

SEQ ID NO: 41030 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKNGVSNKDIEKETAKDSASEPPSMTQLLRR

SEQ ID NO: 41031 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKNGVSNKDIEKETAKDSAAEPPSMTQLLRR

SEQ ID NO: 41032 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKNGVSNKDIEKETAKDAGGEPPSMTQLLRR

SEQ ID NO: 41033 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKNGVSNKDIEKETAKDAGSEPPSMTQLLRR

SEQ ID NO: 41034 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKNGVSNKDIEKETAKDAGAEPPSMTQLLRR

SEQ ID NO: 41035 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKNGVSNKDIEKETAKDASGEPPSMTQLLRR

SEQ ID NO: 41036 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKNGVSNKDIEKETAKDASSEPPSMTQLLRR

SEQ ID NO: 41037 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKNGVSNKDIEKETAKDASAEPPSMTQLLRR

SEQ ID NO: 41038 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKNGVSNKDIEKETAKDAAGEPPSMTQLLRR

SEQ ID NO: 41039 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKNGVSNKDIEKETAKDAASEPPSMTQLLRR

SEQ ID NO: 41040 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKNGVSNKDIEKETAKDAAAEPPSMTQLLRR

SEQ ID NO: 41041 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKMGVSNKDIEKETAKDGGGEPPSMTQLLRR

SEQ ID NO: 41042 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKMGVSNKDIEKETAKDGGSEPPSMTQLLRR

SEQ ID NO: 41043 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKMGVSNKDIEKETAKDGGAEPPSMTQLLRR

SEQ ID NO: 41044 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKMGVSNKDIEKETAKDGSGEPPSMTQLLRR

SEQ ID NO: 41045 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKMGVSNKDIEKETAKDGSSEPPSMTQLLRR

SEQ ID NO: 41046 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKMGVSNKDIEKETAKDGSAEPPSMTQLLRR

SEQ ID NO: 41047 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKMGVSNKDIEKETAKDGAGEPPSMTQLLRR

SEQ ID NO: 41048 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKMGVSNKDIEKETAKDGASEPPSMTQLLRR

SEQ ID NO: 41049 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKMGVSNKDIEKETAKDGAAEPPSMTQLLRR

SEQ ID NO: 41050 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKMGVSNKDIEKETAKDSGGEPPSMTQLLRR

SEQ ID NO: 41051 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKMGVSNKDIEKETAKDSGSEPPSMTQLLRR

SEQ ID NO: 41052 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKMGVSNKDIEKETAKDSGAEPPSMTQLLRR

SEQ ID NO: 41053 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKMGVSNKDIEKETAKDSSGEPPSMTQLLRR

SEQ ID NO: 41054 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKMGVSNKDIEKETAKDSSSEPPSMTQLLRR

SEQ ID NO: 41055 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKMGVSNKDIEKETAKDSSAEPPSMTQLLRR

SEQ ID NO: 41056 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKMGVSNKDIEKETAKDSAGEPPSMTQLLRR

SEQ ID NO: 41057 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKMGVSNKDIEKETAKDSASEPPSMTQLLRR

SEQ ID NO: 41058 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKMGVSNKDIEKETAKDSAAEPPSMTQLLRR

SEQ ID NO: 41059 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKMGVSNKDIEKETAKDAGGEPPSMTQLLRR

SEQ ID NO: 41060 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKMGVSNKDIEKETAKDAGSEPPSMTQLLRR

SEQ ID NO: 41061 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKMGVSNKDIEKETAKDAGAEPPSMTQLLRR

SEQ ID NO: 41062 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKMGVSNKDIEKETAKDASGEPPSMTQLLRR

SEQ ID NO: 41063 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKMGVSNKDIEKETAKDASSEPPSMTQLLRR

SEQ ID NO: 41064 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKMGVSNKDIEKETAKDASAEPPSMTQLLRR

SEQ ID NO: 41065 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKMGVSNKDIEKETAKDAAGEPPSMTQLLRR

SEQ ID NO: 41066 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKMGVSNKDIEKETAKDAASEPPSMTQLLRR

SEQ ID NO: 41067 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKMGVSNKDIEKETAKDAAAEPPSMTQLLRR

SEQ ID NO: 41068 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKCGVSNKDIEKETAKDGGGEPPSMTQLLRR

SEQ ID NO: 41069 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKCGVSNKDIEKETAKDGGSEPPSMTQLLRR

SEQ ID NO: 41070 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKCGVSNKDIEKETAKDGGAEPPSMTQLLRR

SEQ ID NO: 41071 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKCGVSNKDIEKETAKDGSGEPPSMTQLLRR

SEQ ID NO: 41072 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKCGVSNKDIEKETAKDGSSEPPSMTQLLRR

SEQ ID NO: 41073 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKCGVSNKDIEKETAKDGSAEPPSMTQLLRR

SEQ ID NO: 41074 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKCGVSNKDIEKETAKDGAGEPPSMTQLLRR

SEQ ID NO: 41075 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKCGVSNKDIEKETAKDGASEPPSMTQLLRR

SEQ ID NO: 41076 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKCGVSNKDIEKETAKDGAAEPPSMTQLLRR

SEQ ID NO: 41077 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKCGVSNKDIEKETAKDSGGEPPSMTQLLRR

SEQ ID NO: 41078 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKCGVSNKDIEKETAKDSGSEPPSMTQLLRR

SEQ ID NO: 41079 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKCGVSNKDIEKETAKDSGAEPPSMTQLLRR

SEQ ID NO: 41080 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKCGVSNKDIEKETAKDSSGEPPSMTQLLRR

SEQ ID NO: 41081 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKCGVSNKDIEKETAKDSSSEPPSMTQLLRR

SEQ ID NO: 41082 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKCGVSNKDIEKETAKDSSAEPPSMTQLLRR

SEQ ID NO: 41083 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKCGVSNKDIEKETAKDSAGEPPSMTQLLRR

SEQ ID NO: 41084 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKCGVSNKDIEKETAKDSASEPPSMTQLLRR

SEQ ID NO: 41085 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKCGVSNKDIEKETAKDSAAEPPSMTQLLRR

SEQ ID NO: 41086 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKCGVSNKDIEKETAKDAGGEPPSMTQLLRR

SEQ ID NO: 41087 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKCGVSNKDIEKETAKDAGSEPPSMTQLLRR

SEQ ID NO: 41088 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKCGVSNKDIEKETAKDAGAEPPSMTQLLRR

SEQ ID NO: 41089 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKCGVSNKDIEKETAKDASGEPPSMTQLLRR

SEQ ID NO: 41090 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKCGVSNKDIEKETAKDASSEPPSMTQLLRR

SEQ ID NO: 41091 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKCGVSNKDIEKETAKDASAEPPSMTQLLRR

SEQ ID NO: 41092 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKCGVSNKDIEKETAKDAAGEPPSMTQLLRR

SEQ ID NO: 41093 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKCGVSNKDIEKETAKDAASEPPSMTQLLRR

SEQ ID NO: 41094 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKCGVSNKDIEKETAKDAAAEPPSMTQLLRR

SEQ ID NO: 41095 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKSGVSNKDIEKETAKDGGGEPPSMTQLLRR

SEQ ID NO: 41096 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKSGVSNKDIEKETAKDGGSEPPSMTQLLRR

SEQ ID NO: 41097 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKSGVSNKDIEKETAKDGGAEPPSMTQLLRR

SEQ ID NO: 41098 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKSGVSNKDIEKETAKDGSGEPPSMTQLLRR

SEQ ID NO: 41099 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKSGVSNKDIEKETAKDGSSEPPSMTQLLRR

SEQ ID NO: 41100 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKSGVSNKDIEKETAKDGSAEPPSMTQLLRR

SEQ ID NO: 41101 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKSGVSNKDIEKETAKDGAGEPPSMTQLLRR

SEQ ID NO: 41102 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKSGVSNKDIEKETAKDGASEPPSMTQLLRR

SEQ ID NO: 41103 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKSGVSNKDIEKETAKDGAAEPPSMTQLLRR

SEQ ID NO: 41104 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKSGVSNKDIEKETAKDSGGEPPSMTQLLRR

SEQ ID NO: 41105 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKSGVSNKDIEKETAKDSGSEPPSMTQLLRR

SEQ ID NO: 41106 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKSGVSNKDIEKETAKDSGAEPPSMTQLLRR

SEQ ID NO: 41107 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKSGVSNKDIEKETAKDSSGEPPSMTQLLRR

SEQ ID NO: 41108 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKSGVSNKDIEKETAKDSSSEPPSMTQLLRR

SEQ ID NO: 41109 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKSGVSNKDIEKETAKDSSAEPPSMTQLLRR

SEQ ID NO: 41110 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKSGVSNKDIEKETAKDSAGEPPSMTQLLRR

SEQ ID NO: 41111 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKSGVSNKDIEKETAKDSASEPPSMTQLLRR

SEQ ID NO: 41112 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKSGVSNKDIEKETAKDSAAEPPSMTQLLRR

SEQ ID NO: 41113 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKSGVSNKDIEKETAKDAGGEPPSMTQLLRR

SEQ ID NO: 41114 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKSGVSNKDIEKETAKDAGSEPPSMTQLLRR

SEQ ID NO: 41115 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKSGVSNKDIEKETAKDAGAEPPSMTQLLRR

SEQ ID NO: 41116 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKSGVSNKDIEKETAKDASGEPPSMTQLLRR

SEQ ID NO: 41117 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKSGVSNKDIEKETAKDASSEPPSMTQLLRR

SEQ ID NO: 41118 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKSGVSNKDIEKETAKDASAEPPSMTQLLRR

SEQ ID NO: 41119 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKSGVSNKDIEKETAKDAAGEPPSMTQLLRR

SEQ ID NO: 41120 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKSGVSNKDIEKETAKDAASEPPSMTQLLRR

SEQ ID NO: 41121 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKSGVSNKDIEKETAKDAAAEPPSMTQLLRR

SEQ ID NO: 41122 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKAGVSNKDIEKETAKDGGGEPPSMTQLLRR

SEQ ID NO: 41123 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKAGVSNKDIEKETAKDGGSEPPSMTQLLRR

SEQ ID NO: 41124 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKAGVSNKDIEKETAKDGGAEPPSMTQLLRR

SEQ ID NO: 41125 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKAGVSNKDIEKETAKDGSGEPPSMTQLLRR

SEQ ID NO: 41126 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKAGVSNKDIEKETAKDGSSEPPSMTQLLRR

SEQ ID NO: 41127 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKAGVSNKDIEKETAKDGSAEPPSMTQLLRR

SEQ ID NO: 41128 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKAGVSNKDIEKETAKDGAGEPPSMTQLLRR

SEQ ID NO: 41129 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKAGVSNKDIEKETAKDGASEPPSMTQLLRR

SEQ ID NO: 41130 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKAGVSNKDIEKETAKDGAAEPPSMTQLLRR

SEQ ID NO: 41131 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKAGVSNKDIEKETAKDSGGEPPSMTQLLRR

SEQ ID NO: 41132 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKAGVSNKDIEKETAKDSGSEPPSMTQLLRR

SEQ ID NO: 41133 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKAGVSNKDIEKETAKDSGAEPPSMTQLLRR

SEQ ID NO: 41134 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKAGVSNKDIEKETAKDSSGEPPSMTQLLRR

SEQ ID NO: 41135 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKAGVSNKDIEKETAKDSSSEPPSMTQLLRR

SEQ ID NO: 41136 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKAGVSNKDIEKETAKDSSAEPPSMTQLLRR

SEQ ID NO: 41137 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKAGVSNKDIEKETAKDSAGEPPSMTQLLRR

SEQ ID NO: 41138 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKAGVSNKDIEKETAKDSASEPPSMTQLLRR

SEQ ID NO: 41139 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKAGVSNKDIEKETAKDSAAEPPSMTQLLRR

SEQ ID NO: 41140 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKAGVSNKDIEKETAKDAGGEPPSMTQLLRR

SEQ ID NO: 41141 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKAGVSNKDIEKETAKDAGSEPPSMTQLLRR

SEQ ID NO: 41142 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKAGVSNKDIEKETAKDAGAEPPSMTQLLRR

SEQ ID NO: 41143 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKAGVSNKDIEKETAKDASGEPPSMTQLLRR

SEQ ID NO: 41144 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKAGVSNKDIEKETAKDASSEPPSMTQLLRR

SEQ ID NO: 41145 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKAGVSNKDIEKETAKDASAEPPSMTQLLRR

SEQ ID NO: 41146 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKAGVSNKDIEKETAKDAAGEPPSMTQLLRR

SEQ ID NO: 41147 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKAGVSNKDIEKETAKDAASEPPSMTQLLRR

SEQ ID NO: 41148 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKAGVSNKDIEKETAKDAAAEPPSMTQLLRR

SEQ ID NO: 41149 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKGGVSNKDIEKETAKDGGGEPPSMTQLLRR

SEQ ID NO: 41150 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKGGVSNKDIEKETAKDGGSEPPSMTQLLRR

SEQ ID NO: 41151 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKGGVSNKDIEKETAKDGGAEPPSMTQLLRR

SEQ ID NO: 41152 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKGGVSNKDIEKETAKDGSGEPPSMTQLLRR

SEQ ID NO: 41153 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKGGVSNKDIEKETAKDGSSEPPSMTQLLRR

SEQ ID NO: 41154 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKGGVSNKDIEKETAKDGSAEPPSMTQLLRR

SEQ ID NO: 41155 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKGGVSNKDIEKETAKDGAGEPPSMTQLLRR

SEQ ID NO: 41156 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKGGVSNKDIEKETAKDGASEPPSMTQLLRR

SEQ ID NO: 41157 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKGGVSNKDIEKETAKDGAAEPPSMTQLLRR

SEQ ID NO: 41158 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKGGVSNKDIEKETAKDSGGEPPSMTQLLRR

SEQ ID NO: 41159 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKGGVSNKDIEKETAKDSGSEPPSMTQLLRR

SEQ ID NO: 41160 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKGGVSNKDIEKETAKDSGAEPPSMTQLLRR

SEQ ID NO: 41161 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKGGVSNKDIEKETAKDSSGEPPSMTQLLRR

SEQ ID NO: 41162 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKGGVSNKDIEKETAKDSSSEPPSMTQLLRR

SEQ ID NO: 41163 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKGGVSNKDIEKETAKDSSAEPPSMTQLLRR

SEQ ID NO: 41164 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKGGVSNKDIEKETAKDSAGEPPSMTQLLRR

SEQ ID NO: 41165 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKGGVSNKDIEKETAKDSASEPPSMTQLLRR

SEQ ID NO: 41166 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKGGVSNKDIEKETAKDSAAEPPSMTQLLRR

SEQ ID NO: 41167 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKGGVSNKDIEKETAKDAGGEPPSMTQLLRR

SEQ ID NO: 41168 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKGGVSNKDIEKETAKDAGSEPPSMTQLLRR

SEQ ID NO: 41169 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKGGVSNKDIEKETAKDAGAEPPSMTQLLRR

SEQ ID NO: 41170 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKGGVSNKDIEKETAKDASGEPPSMTQLLRR

SEQ ID NO: 41171 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKGGVSNKDIEKETAKDASSEPPSMTQLLRR

SEQ ID NO: 41172 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKGGVSNKDIEKETAKDASAEPPSMTQLLRR

SEQ ID NO: 41173 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKGGVSNKDIEKETAKDAAGEPPSMTQLLRR

SEQ ID NO: 41174 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKGGVSNKDIEKETAKDAASEPPSMTQLLRR

SEQ ID NO: 41175 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKGGVSNKDIEKETAKDAAAEPPSMTQLLRR

SEQ ID NO: 41176 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKDGVSNKDIEKETAKDGGGEPPSMTQLLRR

SEQ ID NO: 41177 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKDGVSNKDIEKETAKDGGSEPPSMTQLLRR

SEQ ID NO: 41178 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKDGVSNKDIEKETAKDGGAEPPSMTQLLRR

SEQ ID NO: 41179 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKDGVSNKDIEKETAKDGSGEPPSMTQLLRR

SEQ ID NO: 41180 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKDGVSNKDIEKETAKDGSSEPPSMTQLLRR

SEQ ID NO: 41181 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKDGVSNKDIEKETAKDGSAEPPSMTQLLRR

SEQ ID NO: 41182 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKDGVSNKDIEKETAKDGAGEPPSMTQLLRR

SEQ ID NO: 41183 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKDGVSNKDIEKETAKDGASEPPSMTQLLRR

SEQ ID NO: 41184 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKDGVSNKDIEKETAKDGAAEPPSMTQLLRR

SEQ ID NO: 41185 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKDGVSNKDIEKETAKDSGGEPPSMTQLLRR

SEQ ID NO: 41186 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKDGVSNKDIEKETAKDSGSEPPSMTQLLRR

SEQ ID NO: 41187 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKDGVSNKDIEKETAKDSGAEPPSMTQLLRR

SEQ ID NO: 41188 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKDGVSNKDIEKETAKDSSGEPPSMTQLLRR

SEQ ID NO: 41189 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKDGVSNKDIEKETAKDSSSEPPSMTQLLRR

SEQ ID NO: 41190 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKDGVSNKDIEKETAKDSSAEPPSMTQLLRR

SEQ ID NO: 41191 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKDGVSNKDIEKETAKDSAGEPPSMTQLLRR

SEQ ID NO: 41192 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKDGVSNKDIEKETAKDSASEPPSMTQLLRR

SEQ ID NO: 41193 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKDGVSNKDIEKETAKDSAAEPPSMTQLLRR

SEQ ID NO: 41194 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKDGVSNKDIEKETAKDAGGEPPSMTQLLRR

SEQ ID NO: 41195 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKDGVSNKDIEKETAKDAGSEPPSMTQLLRR

SEQ ID NO: 41196 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKDGVSNKDIEKETAKDAGAEPPSMTQLLRR

SEQ ID NO: 41197 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKDGVSNKDIEKETAKDASGEPPSMTQLLRR

SEQ ID NO: 41198 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKDGVSNKDIEKETAKDASSEPPSMTQLLRR

SEQ ID NO: 41199 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKDGVSNKDIEKETAKDASAEPPSMTQLLRR

SEQ ID NO: 41200 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKDGVSNKDIEKETAKDAAGEPPSMTQLLRR

SEQ ID NO: 41201 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKDGVSNKDIEKETAKDAASEPPSMTQLLRR

SEQ ID NO: 41202 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKDGVSNKDIEKETAKDAAAEPPSMTQLLRR

SEQ ID NO: 41203 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKHGVSNKDIEKETAKDGGGEPPSMTQLLRR

SEQ ID NO: 41204 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKHGVSNKDIEKETAKDGGSEPPSMTQLLRR

SEQ ID NO: 41205 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKHGVSNKDIEKETAKDGGAEPPSMTQLLRR

SEQ ID NO: 41206 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKHGVSNKDIEKETAKDGSGEPPSMTQLLRR

SEQ ID NO: 41207 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKHGVSNKDIEKETAKDGSSEPPSMTQLLRR

SEQ ID NO: 41208 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKHGVSNKDIEKETAKDGSAEPPSMTQLLRR

SEQ ID NO: 41209 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKHGVSNKDIEKETAKDGAGEPPSMTQLLRR

SEQ ID NO: 41210 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKHGVSNKDIEKETAKDGASEPPSMTQLLRR

SEQ ID NO: 41211 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKHGVSNKDIEKETAKDGAAEPPSMTQLLRR

SEQ ID NO: 41212 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKHGVSNKDIEKETAKDSGGEPPSMTQLLRR

SEQ ID NO: 41213 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKHGVSNKDIEKETAKDSGSEPPSMTQLLRR

SEQ ID NO: 41214 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKHGVSNKDIEKETAKDSGAEPPSMTQLLRR

SEQ ID NO: 41215 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKHGVSNKDIEKETAKDSSGEPPSMTQLLRR

SEQ ID NO: 41216 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKHGVSNKDIEKETAKDSSSEPPSMTQLLRR

SEQ ID NO: 41217 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKHGVSNKDIEKETAKDSSAEPPSMTQLLRR

SEQ ID NO: 41218 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKHGVSNKDIEKETAKDSAGEPPSMTQLLRR

SEQ ID NO: 41219 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKHGVSNKDIEKETAKDSASEPPSMTQLLRR

SEQ ID NO: 41220 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKHGVSNKDIEKETAKDSAAEPPSMTQLLRR

SEQ ID NO: 41221 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKHGVSNKDIEKETAKDAGGEPPSMTQLLRR

SEQ ID NO: 41222 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKHGVSNKDIEKETAKDAGSEPPSMTQLLRR

SEQ ID NO: 41223 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKHGVSNKDIEKETAKDAGAEPPSMTQLLRR

SEQ ID NO: 41224 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKHGVSNKDIEKETAKDASGEPPSMTQLLRR

SEQ ID NO: 41225 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKHGVSNKDIEKETAKDASSEPPSMTQLLRR

SEQ ID NO: 41226 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKHGVSNKDIEKETAKDASAEPPSMTQLLRR

SEQ ID NO: 41227 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKHGVSNKDIEKETAKDAAGEPPSMTQLLRR

SEQ ID NO: 41228 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKHGVSNKDIEKETAKDAASEPPSMTQLLRR

SEQ ID NO: 41229 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKHGVSNKDIEKETAKDAAAEPPSMTQLLRR

SEQ ID NO: 41230 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKYGVSNKDIEKETAKDGGGEPPSMTQLLRR

SEQ ID NO: 41231 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKYGVSNKDIEKETAKDGGSEPPSMTQLLRR

SEQ ID NO: 41232 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKYGVSNKDIEKETAKDGGAEPPSMTQLLRR

SEQ ID NO: 41233 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKYGVSNKDIEKETAKDGSGEPPSMTQLLRR

SEQ ID NO: 41234 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKYGVSNKDIEKETAKDGSSEPPSMTQLLRR

SEQ ID NO: 41235 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKYGVSNKDIEKETAKDGSAEPPSMTQLLRR

SEQ ID NO: 41236 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKYGVSNKDIEKETAKDGAGEPPSMTQLLRR

SEQ ID NO: 41237 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKYGVSNKDIEKETAKDGASEPPSMTQLLRR

SEQ ID NO: 41238 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKYGVSNKDIEKETAKDGAAEPPSMTQLLRR

SEQ ID NO: 41239 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKYGVSNKDIEKETAKDSGGEPPSMTQLLRR

SEQ ID NO: 41240 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKYGVSNKDIEKETAKDSGSEPPSMTQLLRR

SEQ ID NO: 41241 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKYGVSNKDIEKETAKDSGAEPPSMTQLLRR

SEQ ID NO: 41242 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKYGVSNKDIEKETAKDSSGEPPSMTQLLRR

SEQ ID NO: 41243 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKYGVSNKDIEKETAKDSSSEPPSMTQLLRR

SEQ ID NO: 41244 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKYGVSNKDIEKETAKDSSAEPPSMTQLLRR

SEQ ID NO: 41245 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKYGVSNKDIEKETAKDSAGEPPSMTQLLRR

SEQ ID NO: 41246 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKYGVSNKDIEKETAKDSASEPPSMTQLLRR

SEQ ID NO: 41247 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKYGVSNKDIEKETAKDSAAEPPSMTQLLRR

SEQ ID NO: 41248 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKYGVSNKDIEKETAKDAGGEPPSMTQLLRR

SEQ ID NO: 41249 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKYGVSNKDIEKETAKDAGSEPPSMTQLLRR

SEQ ID NO: 41250 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKYGVSNKDIEKETAKDAGAEPPSMTQLLRR

SEQ ID NO: 41251 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKYGVSNKDIEKETAKDASGEPPSMTQLLRR

SEQ ID NO: 41252 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKYGVSNKDIEKETAKDASSEPPSMTQLLRR

SEQ ID NO: 41253 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKYGVSNKDIEKETAKDASAEPPSMTQLLRR

SEQ ID NO: 41254 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKYGVSNKDIEKETAKDAAGEPPSMTQLLRR

SEQ ID NO: 41255 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKYGVSNKDIEKETAKDAASEPPSMTQLLRR

SEQ ID NO: 41256 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKYGVSNKDIEKETAKDAAAEPPSMTQLLRR

SEQ ID NO: 41257 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKKGVSNKDIEKETAKDGGGEPPSMTQLLRR

SEQ ID NO: 41258 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKKGVSNKDIEKETAKDGGSEPPSMTQLLRR

SEQ ID NO: 41259 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKKGVSNKDIEKETAKDGGAEPPSMTQLLRR

SEQ ID NO: 41260 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKKGVSNKDIEKETAKDGSGEPPSMTQLLRR

SEQ ID NO: 41261 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKKGVSNKDIEKETAKDGSSEPPSMTQLLRR

SEQ ID NO: 41262 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKKGVSNKDIEKETAKDGSAEPPSMTQLLRR

SEQ ID NO: 41263 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKKGVSNKDIEKETAKDGAGEPPSMTQLLRR

SEQ ID NO: 41264 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKKGVSNKDIEKETAKDGASEPPSMTQLLRR

SEQ ID NO: 41265 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKKGVSNKDIEKETAKDGAAEPPSMTQLLRR

SEQ ID NO: 41266 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKKGVSNKDIEKETAKDSGGEPPSMTQLLRR

SEQ ID NO: 41267 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKKGVSNKDIEKETAKDSGSEPPSMTQLLRR

SEQ ID NO: 41268 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKKGVSNKDIEKETAKDSGAEPPSMTQLLRR

SEQ ID NO: 41269 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKKGVSNKDIEKETAKDSSGEPPSMTQLLRR

SEQ ID NO: 41270 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKKGVSNKDIEKETAKDSSSEPPSMTQLLRR

SEQ ID NO: 41271 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKKGVSNKDIEKETAKDSSAEPPSMTQLLRR

SEQ ID NO: 41272 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKKGVSNKDIEKETAKDSAGEPPSMTQLLRR

SEQ ID NO: 41273 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKKGVSNKDIEKETAKDSASEPPSMTQLLRR

SEQ ID NO: 41274 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKKGVSNKDIEKETAKDSAAEPPSMTQLLRR

SEQ ID NO: 41275 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKKGVSNKDIEKETAKDAGGEPPSMTQLLRR

SEQ ID NO: 41276 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKKGVSNKDIEKETAKDAGSEPPSMTQLLRR

SEQ ID NO: 41277 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKKGVSNKDIEKETAKDAGAEPPSMTQLLRR

SEQ ID NO: 41278 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKKGVSNKDIEKETAKDASGEPPSMTQLLRR

SEQ ID NO: 41279 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKKGVSNKDIEKETAKDASSEPPSMTQLLRR

SEQ ID NO: 41280 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKKGVSNKDIEKETAKDASAEPPSMTQLLRR

SEQ ID NO: 41281 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKKGVSNKDIEKETAKDAAGEPPSMTQLLRR

SEQ ID NO: 41282 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKKGVSNKDIEKETAKDAASEPPSMTQLLRR

SEQ ID NO: 41283 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKKGVSNKDIEKETAKDAAAEPPSMTQLLRR

SEQ ID NO: 41284 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKNGVSNKDIEKETAKDGGGEPPSMTQLLRR

SEQ ID NO: 41285 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKNGVSNKDIEKETAKDGGSEPPSMTQLLRR

SEQ ID NO: 41286 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKNGVSNKDIEKETAKDGGAEPPSMTQLLRR

SEQ ID NO: 41287 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKNGVSNKDIEKETAKDGSGEPPSMTQLLRR

SEQ ID NO: 41288 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKNGVSNKDIEKETAKDGSSEPPSMTQLLRR

SEQ ID NO: 41289 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKNGVSNKDIEKETAKDGSAEPPSMTQLLRR

SEQ ID NO: 41290 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKNGVSNKDIEKETAKDGAGEPPSMTQLLRR

SEQ ID NO: 41291 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKNGVSNKDIEKETAKDGASEPPSMTQLLRR

SEQ ID NO: 41292 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKNGVSNKDIEKETAKDGAAEPPSMTQLLRR

SEQ ID NO: 41293 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKNGVSNKDIEKETAKDSGGEPPSMTQLLRR

SEQ ID NO: 41294 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKNGVSNKDIEKETAKDSGSEPPSMTQLLRR

SEQ ID NO: 41295 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKNGVSNKDIEKETAKDSGAEPPSMTQLLRR

SEQ ID NO: 41296 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKNGVSNKDIEKETAKDSSGEPPSMTQLLRR

SEQ ID NO: 41297 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKNGVSNKDIEKETAKDSSSEPPSMTQLLRR

SEQ ID NO: 41298 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKNGVSNKDIEKETAKDSSAEPPSMTQLLRR

SEQ ID NO: 41299 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKNGVSNKDIEKETAKDSAGEPPSMTQLLRR

SEQ ID NO: 41300 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKNGVSNKDIEKETAKDSASEPPSMTQLLRR

SEQ ID NO: 41301 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKNGVSNKDIEKETAKDSAAEPPSMTQLLRR

SEQ ID NO: 41302 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKNGVSNKDIEKETAKDAGGEPPSMTQLLRR

SEQ ID NO: 41303 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKNGVSNKDIEKETAKDAGSEPPSMTQLLRR

SEQ ID NO: 41304 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKNGVSNKDIEKETAKDAGAEPPSMTQLLRR

SEQ ID NO: 41305 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKNGVSNKDIEKETAKDASGEPPSMTQLLRR

SEQ ID NO: 41306 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKNGVSNKDIEKETAKDASSEPPSMTQLLRR

SEQ ID NO: 41307 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKNGVSNKDIEKETAKDASAEPPSMTQLLRR

SEQ ID NO: 41308 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKNGVSNKDIEKETAKDAAGEPPSMTQLLRR

SEQ ID NO: 41309 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKNGVSNKDIEKETAKDAASEPPSMTQLLRR

SEQ ID NO: 41310 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKNGVSNKDIEKETAKDAAAEPPSMTQLLRR

SEQ ID NO: 41311 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKMGVSNKDIEKETAKDGGGEPPSMTQLLRR

SEQ ID NO: 41312 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKMGVSNKDIEKETAKDGGSEPPSMTQLLRR

SEQ ID NO: 41313 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKMGVSNKDIEKETAKDGGAEPPSMTQLLRR

SEQ ID NO: 41314 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKMGVSNKDIEKETAKDGSGEPPSMTQLLRR

SEQ ID NO: 41315 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKMGVSNKDIEKETAKDGSSEPPSMTQLLRR

SEQ ID NO: 41316 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKMGVSNKDIEKETAKDGSAEPPSMTQLLRR

SEQ ID NO: 41317 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKMGVSNKDIEKETAKDGAGEPPSMTQLLRR

SEQ ID NO: 41318 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKMGVSNKDIEKETAKDGASEPPSMTQLLRR

SEQ ID NO: 41319 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKMGVSNKDIEKETAKDGAAEPPSMTQLLRR

SEQ ID NO: 41320 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKMGVSNKDIEKETAKDSGGEPPSMTQLLRR

SEQ ID NO: 41321 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKMGVSNKDIEKETAKDSGSEPPSMTQLLRR

SEQ ID NO: 41322 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKMGVSNKDIEKETAKDSGAEPPSMTQLLRR

SEQ ID NO: 41323 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKMGVSNKDIEKETAKDSSGEPPSMTQLLRR

SEQ ID NO: 41324 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKMGVSNKDIEKETAKDSSSEPPSMTQLLRR

SEQ ID NO: 41325 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKMGVSNKDIEKETAKDSSAEPPSMTQLLRR

SEQ ID NO: 41326 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKMGVSNKDIEKETAKDSAGEPPSMTQLLRR

SEQ ID NO: 41327 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKMGVSNKDIEKETAKDSASEPPSMTQLLRR

SEQ ID NO: 41328 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKMGVSNKDIEKETAKDSAAEPPSMTQLLRR

SEQ ID NO: 41329 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKMGVSNKDIEKETAKDAGGEPPSMTQLLRR

SEQ ID NO: 41330 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKMGVSNKDIEKETAKDAGSEPPSMTQLLRR

SEQ ID NO: 41331 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKMGVSNKDIEKETAKDAGAEPPSMTQLLRR

SEQ ID NO: 41332 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKMGVSNKDIEKETAKDASGEPPSMTQLLRR

SEQ ID NO: 41333 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKMGVSNKDIEKETAKDASSEPPSMTQLLRR

SEQ ID NO: 41334 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKMGVSNKDIEKETAKDASAEPPSMTQLLRR

SEQ ID NO: 41335 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKMGVSNKDIEKETAKDAAGEPPSMTQLLRR

SEQ ID NO: 41336 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKMGVSNKDIEKETAKDAASEPPSMTQLLRR

SEQ ID NO: 41337 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKMGVSNKDIEKETAKDAAAEPPSMTQLLRR

SEQ ID NO: 41338 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKCGVSNKDIEKETAKDGGGEPPSMTQLLRR

SEQ ID NO: 41339 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKCGVSNKDIEKETAKDGGSEPPSMTQLLRR

SEQ ID NO: 41340 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKCGVSNKDIEKETAKDGGAEPPSMTQLLRR

SEQ ID NO: 41341 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKCGVSNKDIEKETAKDGSGEPPSMTQLLRR

SEQ ID NO: 41342 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKCGVSNKDIEKETAKDGSSEPPSMTQLLRR

SEQ ID NO: 41343 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKCGVSNKDIEKETAKDGSAEPPSMTQLLRR

SEQ ID NO: 41344 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKCGVSNKDIEKETAKDGAGEPPSMTQLLRR

SEQ ID NO: 41345 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKCGVSNKDIEKETAKDGASEPPSMTQLLRR

SEQ ID NO: 41346 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKCGVSNKDIEKETAKDGAAEPPSMTQLLRR

SEQ ID NO: 41347 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKCGVSNKDIEKETAKDSGGEPPSMTQLLRR

SEQ ID NO: 41348 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKCGVSNKDIEKETAKDSGSEPPSMTQLLRR

SEQ ID NO: 41349 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKCGVSNKDIEKETAKDSGAEPPSMTQLLRR

SEQ ID NO: 41350 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKCGVSNKDIEKETAKDSSGEPPSMTQLLRR

SEQ ID NO: 41351 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKCGVSNKDIEKETAKDSSSEPPSMTQLLRR

SEQ ID NO: 41352 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKCGVSNKDIEKETAKDSSAEPPSMTQLLRR

SEQ ID NO: 41353 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKCGVSNKDIEKETAKDSAGEPPSMTQLLRR

SEQ ID NO: 41354 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKCGVSNKDIEKETAKDSASEPPSMTQLLRR

SEQ ID NO: 41355 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKCGVSNKDIEKETAKDSAAEPPSMTQLLRR

SEQ ID NO: 41356 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKCGVSNKDIEKETAKDAGGEPPSMTQLLRR

SEQ ID NO: 41357 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKCGVSNKDIEKETAKDAGSEPPSMTQLLRR

SEQ ID NO: 41358 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKCGVSNKDIEKETAKDAGAEPPSMTQLLRR

SEQ ID NO: 41359 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKCGVSNKDIEKETAKDASGEPPSMTQLLRR

SEQ ID NO: 41360 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKCGVSNKDIEKETAKDASSEPPSMTQLLRR

SEQ ID NO: 41361 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKCGVSNKDIEKETAKDASAEPPSMTQLLRR

SEQ ID NO: 41362 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKCGVSNKDIEKETAKDAAGEPPSMTQLLRR

SEQ ID NO: 41363 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKCGVSNKDIEKETAKDAASEPPSMTQLLRR

SEQ ID NO: 41364 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKCGVSNKDIEKETAKDAAAEPPSMTQLLRR

SEQ ID NO: 41365 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKSGVSNKDIEKETAKDGGGEPPSMTQLLRR

SEQ ID NO: 41366 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKSGVSNKDIEKETAKDGGSEPPSMTQLLRR

SEQ ID NO: 41367 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKSGVSNKDIEKETAKDGGAEPPSMTQLLRR

SEQ ID NO: 41368 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKSGVSNKDIEKETAKDGSGEPPSMTQLLRR

SEQ ID NO: 41369 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKSGVSNKDIEKETAKDGSSEPPSMTQLLRR

SEQ ID NO: 41370 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKSGVSNKDIEKETAKDGSAEPPSMTQLLRR

SEQ ID NO: 41371 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKSGVSNKDIEKETAKDGAGEPPSMTQLLRR

SEQ ID NO: 41372 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKSGVSNKDIEKETAKDGASEPPSMTQLLRR

SEQ ID NO: 41373 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKSGVSNKDIEKETAKDGAAEPPSMTQLLRR

SEQ ID NO: 41374 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKSGVSNKDIEKETAKDSGGEPPSMTQLLRR

SEQ ID NO: 41375 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKSGVSNKDIEKETAKDSGSEPPSMTQLLRR

SEQ ID NO: 41376 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKSGVSNKDIEKETAKDSGAEPPSMTQLLRR

SEQ ID NO: 41377 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKSGVSNKDIEKETAKDSSGEPPSMTQLLRR

SEQ ID NO: 41378 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKSGVSNKDIEKETAKDSSSEPPSMTQLLRR

SEQ ID NO: 41379 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKSGVSNKDIEKETAKDSSAEPPSMTQLLRR

SEQ ID NO: 41380 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKSGVSNKDIEKETAKDSAGEPPSMTQLLRR

SEQ ID NO: 41381 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKSGVSNKDIEKETAKDSASEPPSMTQLLRR

SEQ ID NO: 41382 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKSGVSNKDIEKETAKDSAAEPPSMTQLLRR

SEQ ID NO: 41383 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKSGVSNKDIEKETAKDAGGEPPSMTQLLRR

SEQ ID NO: 41384 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKSGVSNKDIEKETAKDAGSEPPSMTQLLRR

SEQ ID NO: 41385 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKSGVSNKDIEKETAKDAGAEPPSMTQLLRR

SEQ ID NO: 41386 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKSGVSNKDIEKETAKDASGEPPSMTQLLRR

SEQ ID NO: 41387 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKSGVSNKDIEKETAKDASSEPPSMTQLLRR

SEQ ID NO: 41388 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKSGVSNKDIEKETAKDASAEPPSMTQLLRR

SEQ ID NO: 41389 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKSGVSNKDIEKETAKDAAGEPPSMTQLLRR

SEQ ID NO: 41390 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKSGVSNKDIEKETAKDAASEPPSMTQLLRR

SEQ ID NO: 41391 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKSGVSNKDIEKETAKDAAAEPPSMTQLLRR

SEQ ID NO: 41392 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKAGVSNKDIEKETAKDGGGEPPSMTQLLRR

SEQ ID NO: 41393 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKAGVSNKDIEKETAKDGGSEPPSMTQLLRR

SEQ ID NO: 41394 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKAGVSNKDIEKETAKDGGAEPPSMTQLLRR

SEQ ID NO: 41395 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKAGVSNKDIEKETAKDGSGEPPSMTQLLRR

SEQ ID NO: 41396 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKAGVSNKDIEKETAKDGSSEPPSMTQLLRR

SEQ ID NO: 41397 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKAGVSNKDIEKETAKDGSAEPPSMTQLLRR

SEQ ID NO: 41398 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKAGVSNKDIEKETAKDGAGEPPSMTQLLRR

SEQ ID NO: 41399 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKAGVSNKDIEKETAKDGASEPPSMTQLLRR

SEQ ID NO: 41400 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKAGVSNKDIEKETAKDGAAEPPSMTQLLRR

SEQ ID NO: 41401 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKAGVSNKDIEKETAKDSGGEPPSMTQLLRR

SEQ ID NO: 41402 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKAGVSNKDIEKETAKDSGSEPPSMTQLLRR

SEQ ID NO: 41403 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKAGVSNKDIEKETAKDSGAEPPSMTQLLRR

SEQ ID NO: 41404 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKAGVSNKDIEKETAKDSSGEPPSMTQLLRR

SEQ ID NO: 41405 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKAGVSNKDIEKETAKDSSSEPPSMTQLLRR

SEQ ID NO: 41406 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKAGVSNKDIEKETAKDSSAEPPSMTQLLRR

SEQ ID NO: 41407 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKAGVSNKDIEKETAKDSAGEPPSMTQLLRR

SEQ ID NO: 41408 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKAGVSNKDIEKETAKDSASEPPSMTQLLRR

SEQ ID NO: 41409 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKAGVSNKDIEKETAKDSAAEPPSMTQLLRR

SEQ ID NO: 41410 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKAGVSNKDIEKETAKDAGGEPPSMTQLLRR

SEQ ID NO: 41411 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKAGVSNKDIEKETAKDAGSEPPSMTQLLRR

SEQ ID NO: 41412 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKAGVSNKDIEKETAKDAGAEPPSMTQLLRR

SEQ ID NO: 41413 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKAGVSNKDIEKETAKDASGEPPSMTQLLRR

SEQ ID NO: 41414 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKAGVSNKDIEKETAKDASSEPPSMTQLLRR

SEQ ID NO: 41415 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKAGVSNKDIEKETAKDASAEPPSMTQLLRR

SEQ ID NO: 41416 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKAGVSNKDIEKETAKDAAGEPPSMTQLLRR

SEQ ID NO: 41417 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKAGVSNKDIEKETAKDAASEPPSMTQLLRR

SEQ ID NO: 41418 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKAGVSNKDIEKETAKDAAAEPPSMTQLLRR

SEQ ID NO: 41419 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKGGVSNKDIEKETAKDGGGEPPSMTQLLRR

SEQ ID NO: 41420 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKGGVSNKDIEKETAKDGGSEPPSMTQLLRR

SEQ ID NO: 41421 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKGGVSNKDIEKETAKDGGAEPPSMTQLLRR

SEQ ID NO: 41422 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKGGVSNKDIEKETAKDGSGEPPSMTQLLRR

SEQ ID NO: 41423 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKGGVSNKDIEKETAKDGSSEPPSMTQLLRR

SEQ ID NO: 41424 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKGGVSNKDIEKETAKDGSAEPPSMTQLLRR

SEQ ID NO: 41425 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKGGVSNKDIEKETAKDGAGEPPSMTQLLRR

SEQ ID NO: 41426 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKGGVSNKDIEKETAKDGASEPPSMTQLLRR

SEQ ID NO: 41427 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKGGVSNKDIEKETAKDGAAEPPSMTQLLRR

SEQ ID NO: 41428 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKGGVSNKDIEKETAKDSGGEPPSMTQLLRR

SEQ ID NO: 41429 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKGGVSNKDIEKETAKDSGSEPPSMTQLLRR

SEQ ID NO: 41430 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKGGVSNKDIEKETAKDSGAEPPSMTQLLRR

SEQ ID NO: 41431 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKGGVSNKDIEKETAKDSSGEPPSMTQLLRR

SEQ ID NO: 41432 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKGGVSNKDIEKETAKDSSSEPPSMTQLLRR

SEQ ID NO: 41433 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKGGVSNKDIEKETAKDSSAEPPSMTQLLRR

SEQ ID NO: 41434 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKGGVSNKDIEKETAKDSAGEPPSMTQLLRR

SEQ ID NO: 41435 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKGGVSNKDIEKETAKDSASEPPSMTQLLRR

SEQ ID NO: 41436 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKGGVSNKDIEKETAKDSAAEPPSMTQLLRR

SEQ ID NO: 41437 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKGGVSNKDIEKETAKDAGGEPPSMTQLLRR

SEQ ID NO: 41438 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKGGVSNKDIEKETAKDAGSEPPSMTQLLRR

SEQ ID NO: 41439 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKGGVSNKDIEKETAKDAGAEPPSMTQLLRR

SEQ ID NO: 41440 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKGGVSNKDIEKETAKDASGEPPSMTQLLRR

SEQ ID NO: 41441 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKGGVSNKDIEKETAKDASSEPPSMTQLLRR

SEQ ID NO: 41442 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKGGVSNKDIEKETAKDASAEPPSMTQLLRR

SEQ ID NO: 41443 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKGGVSNKDIEKETAKDAAGEPPSMTQLLRR

SEQ ID NO: 41444 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKGGVSNKDIEKETAKDAASEPPSMTQLLRR

SEQ ID NO: 41445 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKGGVSNKDIEKETAKDAAAEPPSMTQLLRR

SEQ ID NO: 41446 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKDGVSNKDIEKETAKDGGGEPPSMTQLLRR

SEQ ID NO: 41447 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKDGVSNKDIEKETAKDGGSEPPSMTQLLRR

SEQ ID NO: 41448 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKDGVSNKDIEKETAKDGGAEPPSMTQLLRR

SEQ ID NO: 41449 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKDGVSNKDIEKETAKDGSGEPPSMTQLLRR

SEQ ID NO: 41450 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKDGVSNKDIEKETAKDGSSEPPSMTQLLRR

SEQ ID NO: 41451 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKDGVSNKDIEKETAKDGSAEPPSMTQLLRR

SEQ ID NO: 41452 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKDGVSNKDIEKETAKDGAGEPPSMTQLLRR

SEQ ID NO: 41453 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKDGVSNKDIEKETAKDGASEPPSMTQLLRR

SEQ ID NO: 41454 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKDGVSNKDIEKETAKDGAAEPPSMTQLLRR

SEQ ID NO: 41455 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKDGVSNKDIEKETAKDSGGEPPSMTQLLRR

SEQ ID NO: 41456 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKDGVSNKDIEKETAKDSGSEPPSMTQLLRR

SEQ ID NO: 41457 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKDGVSNKDIEKETAKDSGAEPPSMTQLLRR

SEQ ID NO: 41458 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKDGVSNKDIEKETAKDSSGEPPSMTQLLRR

SEQ ID NO: 41459 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKDGVSNKDIEKETAKDSSSEPPSMTQLLRR

SEQ ID NO: 41460 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKDGVSNKDIEKETAKDSSAEPPSMTQLLRR

SEQ ID NO: 41461 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKDGVSNKDIEKETAKDSAGEPPSMTQLLRR

SEQ ID NO: 41462 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKDGVSNKDIEKETAKDSASEPPSMTQLLRR

SEQ ID NO: 41463 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKDGVSNKDIEKETAKDSAAEPPSMTQLLRR

SEQ ID NO: 41464 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKDGVSNKDIEKETAKDAGGEPPSMTQLLRR

SEQ ID NO: 41465 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKDGVSNKDIEKETAKDAGSEPPSMTQLLRR

SEQ ID NO: 41466 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKDGVSNKDIEKETAKDAGAEPPSMTQLLRR

SEQ ID NO: 41467 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKDGVSNKDIEKETAKDASGEPPSMTQLLRR

SEQ ID NO: 41468 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKDGVSNKDIEKETAKDASSEPPSMTQLLRR

SEQ ID NO: 41469 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKDGVSNKDIEKETAKDASAEPPSMTQLLRR

SEQ ID NO: 41470 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKDGVSNKDIEKETAKDAAGEPPSMTQLLRR

SEQ ID NO: 41471 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKDGVSNKDIEKETAKDAASEPPSMTQLLRR

SEQ ID NO: 41472 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKDGVSNKDIEKETAKDAAAEPPSMTQLLRR

SEQ ID NO: 41473 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKHGVSNKDIEKETAKDGGGEPPSMTQLLRR

SEQ ID NO: 41474 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKHGVSNKDIEKETAKDGGSEPPSMTQLLRR

SEQ ID NO: 41475 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKHGVSNKDIEKETAKDGGAEPPSMTQLLRR

SEQ ID NO: 41476 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKHGVSNKDIEKETAKDGSGEPPSMTQLLRR

SEQ ID NO: 41477 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKHGVSNKDIEKETAKDGSSEPPSMTQLLRR

SEQ ID NO: 41478 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKHGVSNKDIEKETAKDGSAEPPSMTQLLRR

SEQ ID NO: 41479 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKHGVSNKDIEKETAKDGAGEPPSMTQLLRR

SEQ ID NO: 41480 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKHGVSNKDIEKETAKDGASEPPSMTQLLRR

SEQ ID NO: 41481 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKHGVSNKDIEKETAKDGAAEPPSMTQLLRR

SEQ ID NO: 41482 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKHGVSNKDIEKETAKDSGGEPPSMTQLLRR

SEQ ID NO: 41483 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKHGVSNKDIEKETAKDSGSEPPSMTQLLRR

SEQ ID NO: 41484 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKHGVSNKDIEKETAKDSGAEPPSMTQLLRR

SEQ ID NO: 41485 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKHGVSNKDIEKETAKDSSGEPPSMTQLLRR

SEQ ID NO: 41486 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKHGVSNKDIEKETAKDSSSEPPSMTQLLRR

SEQ ID NO: 41487 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKHGVSNKDIEKETAKDSSAEPPSMTQLLRR

SEQ ID NO: 41488 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKHGVSNKDIEKETAKDSAGEPPSMTQLLRR

SEQ ID NO: 41489 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKHGVSNKDIEKETAKDSASEPPSMTQLLRR

SEQ ID NO: 41490 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKHGVSNKDIEKETAKDSAAEPPSMTQLLRR

SEQ ID NO: 41491 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKHGVSNKDIEKETAKDAGGEPPSMTQLLRR

SEQ ID NO: 41492 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKHGVSNKDIEKETAKDAGSEPPSMTQLLRR

SEQ ID NO: 41493 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKHGVSNKDIEKETAKDAGAEPPSMTQLLRR

SEQ ID NO: 41494 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKHGVSNKDIEKETAKDASGEPPSMTQLLRR

SEQ ID NO: 41495 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKHGVSNKDIEKETAKDASSEPPSMTQLLRR

SEQ ID NO: 41496 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKHGVSNKDIEKETAKDASAEPPSMTQLLRR

SEQ ID NO: 41497 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKHGVSNKDIEKETAKDAAGEPPSMTQLLRR

SEQ ID NO: 41498 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKHGVSNKDIEKETAKDAASEPPSMTQLLRR

SEQ ID NO: 41499 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKHGVSNKDIEKETAKDAAAEPPSMTQLLRR

SEQ ID NO: 41500 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKYGVSNKDIEKETAKDGGGEPPSMTQLLRR

SEQ ID NO: 41501 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKYGVSNKDIEKETAKDGGSEPPSMTQLLRR

SEQ ID NO: 41502 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKYGVSNKDIEKETAKDGGAEPPSMTQLLRR

SEQ ID NO: 41503 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKYGVSNKDIEKETAKDGSGEPPSMTQLLRR

SEQ ID NO: 41504 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKYGVSNKDIEKETAKDGSSEPPSMTQLLRR

SEQ ID NO: 41505 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKYGVSNKDIEKETAKDGSAEPPSMTQLLRR

SEQ ID NO: 41506 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKYGVSNKDIEKETAKDGAGEPPSMTQLLRR

SEQ ID NO: 41507 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKYGVSNKDIEKETAKDGASEPPSMTQLLRR

SEQ ID NO: 41508 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKYGVSNKDIEKETAKDGAAEPPSMTQLLRR

SEQ ID NO: 41509 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKYGVSNKDIEKETAKDSGGEPPSMTQLLRR

SEQ ID NO: 41510 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKYGVSNKDIEKETAKDSGSEPPSMTQLLRR

SEQ ID NO: 41511 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKYGVSNKDIEKETAKDSGAEPPSMTQLLRR

SEQ ID NO: 41512 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKYGVSNKDIEKETAKDSSGEPPSMTQLLRR

SEQ ID NO: 41513 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKYGVSNKDIEKETAKDSSSEPPSMTQLLRR

SEQ ID NO: 41514 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKYGVSNKDIEKETAKDSSAEPPSMTQLLRR

SEQ ID NO: 41515 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKYGVSNKDIEKETAKDSAGEPPSMTQLLRR

SEQ ID NO: 41516 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKYGVSNKDIEKETAKDSASEPPSMTQLLRR

SEQ ID NO: 41517 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKYGVSNKDIEKETAKDSAAEPPSMTQLLRR

SEQ ID NO: 41518 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKYGVSNKDIEKETAKDAGGEPPSMTQLLRR

SEQ ID NO: 41519 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKYGVSNKDIEKETAKDAGSEPPSMTQLLRR

SEQ ID NO: 41520 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKYGVSNKDIEKETAKDAGAEPPSMTQLLRR

SEQ ID NO: 41521 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKYGVSNKDIEKETAKDASGEPPSMTQLLRR

SEQ ID NO: 41522 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKYGVSNKDIEKETAKDASSEPPSMTQLLRR

SEQ ID NO: 41523 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKYGVSNKDIEKETAKDASAEPPSMTQLLRR

SEQ ID NO: 41524 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKYGVSNKDIEKETAKDAAGEPPSMTQLLRR

SEQ ID NO: 41525 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKYGVSNKDIEKETAKDAASEPPSMTQLLRR

SEQ ID NO: 41526 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKYGVSNKDIEKETAKDAAAEPPSMTQLLRR

SEQ ID NO: 41527 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKKGVSNKDIEKETAKDGGGEPPSMTQLLRR

SEQ ID NO: 41528 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKKGVSNKDIEKETAKDGGSEPPSMTQLLRR

SEQ ID NO: 41529 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKKGVSNKDIEKETAKDGGAEPPSMTQLLRR

SEQ ID NO: 41530 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKKGVSNKDIEKETAKDGSGEPPSMTQLLRR

SEQ ID NO: 41531 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKKGVSNKDIEKETAKDGSSEPPSMTQLLRR

SEQ ID NO: 41532 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKKGVSNKDIEKETAKDGSAEPPSMTQLLRR

SEQ ID NO: 41533 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKKGVSNKDIEKETAKDGAGEPPSMTQLLRR

SEQ ID NO: 41534 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKKGVSNKDIEKETAKDGASEPPSMTQLLRR

SEQ ID NO: 41535 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKKGVSNKDIEKETAKDGAAEPPSMTQLLRR

SEQ ID NO: 41536 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKKGVSNKDIEKETAKDSGGEPPSMTQLLRR

SEQ ID NO: 41537 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKKGVSNKDIEKETAKDSGSEPPSMTQLLRR

SEQ ID NO: 41538 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKKGVSNKDIEKETAKDSGAEPPSMTQLLRR

SEQ ID NO: 41539 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKKGVSNKDIEKETAKDSSGEPPSMTQLLRR

SEQ ID NO: 41540 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKKGVSNKDIEKETAKDSSSEPPSMTQLLRR

SEQ ID NO: 41541 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKKGVSNKDIEKETAKDSSAEPPSMTQLLRR

SEQ ID NO: 41542 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKKGVSNKDIEKETAKDSAGEPPSMTQLLRR

SEQ ID NO: 41543 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKKGVSNKDIEKETAKDSASEPPSMTQLLRR

SEQ ID NO: 41544 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKKGVSNKDIEKETAKDSAAEPPSMTQLLRR

SEQ ID NO: 41545 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKKGVSNKDIEKETAKDAGGEPPSMTQLLRR

SEQ ID NO: 41546 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKKGVSNKDIEKETAKDAGSEPPSMTQLLRR

SEQ ID NO: 41547 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKKGVSNKDIEKETAKDAGAEPPSMTQLLRR

SEQ ID NO: 41548 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKKGVSNKDIEKETAKDASGEPPSMTQLLRR

SEQ ID NO: 41549 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKKGVSNKDIEKETAKDASSEPPSMTQLLRR

SEQ ID NO: 41550 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKKGVSNKDIEKETAKDASAEPPSMTQLLRR

SEQ ID NO: 41551 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKKGVSNKDIEKETAKDAAGEPPSMTQLLRR

SEQ ID NO: 41552 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKKGVSNKDIEKETAKDAASEPPSMTQLLRR

SEQ ID NO: 41553 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKKGVSNKDIEKETAKDAAAEPPSMTQLLRR

SEQ ID NO: 41554 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKNGVSNKDIEKETAKDGGGEPPSMTQLLRR

SEQ ID NO: 41555 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKNGVSNKDIEKETAKDGGSEPPSMTQLLRR

SEQ ID NO: 41556 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKNGVSNKDIEKETAKDGGAEPPSMTQLLRR

SEQ ID NO: 41557 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKNGVSNKDIEKETAKDGSGEPPSMTQLLRR

SEQ ID NO: 41558 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKNGVSNKDIEKETAKDGSSEPPSMTQLLRR

SEQ ID NO: 41559 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKNGVSNKDIEKETAKDGSAEPPSMTQLLRR

SEQ ID NO: 41560 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKNGVSNKDIEKETAKDGAGEPPSMTQLLRR

SEQ ID NO: 41561 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKNGVSNKDIEKETAKDGASEPPSMTQLLRR

SEQ ID NO: 41562 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKNGVSNKDIEKETAKDGAAEPPSMTQLLRR

SEQ ID NO: 41563 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKNGVSNKDIEKETAKDSGGEPPSMTQLLRR

SEQ ID NO: 41564 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKNGVSNKDIEKETAKDSGSEPPSMTQLLRR

SEQ ID NO: 41565 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKNGVSNKDIEKETAKDSGAEPPSMTQLLRR

SEQ ID NO: 41566 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKNGVSNKDIEKETAKDSSGEPPSMTQLLRR

SEQ ID NO: 41567 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKNGVSNKDIEKETAKDSSSEPPSMTQLLRR

SEQ ID NO: 41568 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKNGVSNKDIEKETAKDSSAEPPSMTQLLRR

SEQ ID NO: 41569 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKNGVSNKDIEKETAKDSAGEPPSMTQLLRR

SEQ ID NO: 41570 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKNGVSNKDIEKETAKDSASEPPSMTQLLRR

SEQ ID NO: 41571 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKNGVSNKDIEKETAKDSAAEPPSMTQLLRR

SEQ ID NO: 41572 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKNGVSNKDIEKETAKDAGGEPPSMTQLLRR

SEQ ID NO: 41573 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKNGVSNKDIEKETAKDAGSEPPSMTQLLRR

SEQ ID NO: 41574 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKNGVSNKDIEKETAKDAGAEPPSMTQLLRR

SEQ ID NO: 41575 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKNGVSNKDIEKETAKDASGEPPSMTQLLRR

SEQ ID NO: 41576 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKNGVSNKDIEKETAKDASSEPPSMTQLLRR

SEQ ID NO: 41577 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKNGVSNKDIEKETAKDASAEPPSMTQLLRR

SEQ ID NO: 41578 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKNGVSNKDIEKETAKDAAGEPPSMTQLLRR

SEQ ID NO: 41579 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKNGVSNKDIEKETAKDAASEPPSMTQLLRR

SEQ ID NO: 41580 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKNGVSNKDIEKETAKDAAAEPPSMTQLLRR

SEQ ID NO: 41581 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKMGVSNKDIEKETAKDGGGEPPSMTQLLRR

SEQ ID NO: 41582 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKMGVSNKDIEKETAKDGGSEPPSMTQLLRR

SEQ ID NO: 41583 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKMGVSNKDIEKETAKDGGAEPPSMTQLLRR

SEQ ID NO: 41584 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKMGVSNKDIEKETAKDGSGEPPSMTQLLRR

SEQ ID NO: 41585 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKMGVSNKDIEKETAKDGSSEPPSMTQLLRR

SEQ ID NO: 41586 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKMGVSNKDIEKETAKDGSAEPPSMTQLLRR

SEQ ID NO: 41587 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKMGVSNKDIEKETAKDGAGEPPSMTQLLRR

SEQ ID NO: 41588 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKMGVSNKDIEKETAKDGASEPPSMTQLLRR

SEQ ID NO: 41589 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKMGVSNKDIEKETAKDGAAEPPSMTQLLRR

SEQ ID NO: 41590 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKMGVSNKDIEKETAKDSGGEPPSMTQLLRR

SEQ ID NO: 41591 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKMGVSNKDIEKETAKDSGSEPPSMTQLLRR

SEQ ID NO: 41592 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKMGVSNKDIEKETAKDSGAEPPSMTQLLRR

SEQ ID NO: 41593 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKMGVSNKDIEKETAKDSSGEPPSMTQLLRR

SEQ ID NO: 41594 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKMGVSNKDIEKETAKDSSSEPPSMTQLLRR

SEQ ID NO: 41595 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKMGVSNKDIEKETAKDSSAEPPSMTQLLRR

SEQ ID NO: 41596 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKMGVSNKDIEKETAKDSAGEPPSMTQLLRR

SEQ ID NO: 41597 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKMGVSNKDIEKETAKDSASEPPSMTQLLRR

SEQ ID NO: 41598 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKMGVSNKDIEKETAKDSAAEPPSMTQLLRR

SEQ ID NO: 41599 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKMGVSNKDIEKETAKDAGGEPPSMTQLLRR

SEQ ID NO: 41600 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKMGVSNKDIEKETAKDAGSEPPSMTQLLRR

SEQ ID NO: 41601 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKMGVSNKDIEKETAKDAGAEPPSMTQLLRR

SEQ ID NO: 41602 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKMGVSNKDIEKETAKDASGEPPSMTQLLRR

SEQ ID NO: 41603 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKMGVSNKDIEKETAKDASSEPPSMTQLLRR

SEQ ID NO: 41604 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKMGVSNKDIEKETAKDASAEPPSMTQLLRR

SEQ ID NO: 41605 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKMGVSNKDIEKETAKDAAGEPPSMTQLLRR

SEQ ID NO: 41606 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKMGVSNKDIEKETAKDAASEPPSMTQLLRR

SEQ ID NO: 41607 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKMGVSNKDIEKETAKDAAAEPPSMTQLLRR

SEQ ID NO: 41608 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKCGVSNKDIEKETAKDGGGEPPSMTQLLRR

SEQ ID NO: 41609 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKCGVSNKDIEKETAKDGGSEPPSMTQLLRR

SEQ ID NO: 41610 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKCGVSNKDIEKETAKDGGAEPPSMTQLLRR

SEQ ID NO: 41611 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKCGVSNKDIEKETAKDGSGEPPSMTQLLRR

SEQ ID NO: 41612 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKCGVSNKDIEKETAKDGSSEPPSMTQLLRR

SEQ ID NO: 41613 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKCGVSNKDIEKETAKDGSAEPPSMTQLLRR

SEQ ID NO: 41614 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKCGVSNKDIEKETAKDGAGEPPSMTQLLRR

SEQ ID NO: 41615 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKCGVSNKDIEKETAKDGASEPPSMTQLLRR

SEQ ID NO: 41616 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKCGVSNKDIEKETAKDGAAEPPSMTQLLRR

SEQ ID NO: 41617 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKCGVSNKDIEKETAKDSGGEPPSMTQLLRR

SEQ ID NO: 41618 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKCGVSNKDIEKETAKDSGSEPPSMTQLLRR

SEQ ID NO: 41619 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKCGVSNKDIEKETAKDSGAEPPSMTQLLRR

SEQ ID NO: 41620 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKCGVSNKDIEKETAKDSSGEPPSMTQLLRR

SEQ ID NO: 41621 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKCGVSNKDIEKETAKDSSSEPPSMTQLLRR

SEQ ID NO: 41622 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKCGVSNKDIEKETAKDSSAEPPSMTQLLRR

SEQ ID NO: 41623 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKCGVSNKDIEKETAKDSAGEPPSMTQLLRR

SEQ ID NO: 41624 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKCGVSNKDIEKETAKDSASEPPSMTQLLRR

SEQ ID NO: 41625 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKCGVSNKDIEKETAKDSAAEPPSMTQLLRR

SEQ ID NO: 41626 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKCGVSNKDIEKETAKDAGGEPPSMTQLLRR

SEQ ID NO: 41627 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKCGVSNKDIEKETAKDAGSEPPSMTQLLRR

SEQ ID NO: 41628 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKCGVSNKDIEKETAKDAGAEPPSMTQLLRR

SEQ ID NO: 41629 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKCGVSNKDIEKETAKDASGEPPSMTQLLRR

SEQ ID NO: 41630 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKCGVSNKDIEKETAKDASSEPPSMTQLLRR

SEQ ID NO: 41631 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKCGVSNKDIEKETAKDASAEPPSMTQLLRR

SEQ ID NO: 41632 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKCGVSNKDIEKETAKDAAGEPPSMTQLLRR

SEQ ID NO: 41633 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKCGVSNKDIEKETAKDAASEPPSMTQLLRR

SEQ ID NO: 41634 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKCGVSNKDIEKETAKDAAAEPPSMTQLLRR

SEQ ID NO: 41635 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKSGVSNKDIEKETAKDGGGEPPSMTQLLRR

SEQ ID NO: 41636 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKSGVSNKDIEKETAKDGGSEPPSMTQLLRR

SEQ ID NO: 41637 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKSGVSNKDIEKETAKDGGAEPPSMTQLLRR

SEQ ID NO: 41638 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKSGVSNKDIEKETAKDGSGEPPSMTQLLRR

SEQ ID NO: 41639 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKSGVSNKDIEKETAKDGSSEPPSMTQLLRR

SEQ ID NO: 41640 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKSGVSNKDIEKETAKDGSAEPPSMTQLLRR

SEQ ID NO: 41641 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKSGVSNKDIEKETAKDGAGEPPSMTQLLRR

SEQ ID NO: 41642 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKSGVSNKDIEKETAKDGASEPPSMTQLLRR

SEQ ID NO: 41643 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKSGVSNKDIEKETAKDGAAEPPSMTQLLRR

SEQ ID NO: 41644 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKSGVSNKDIEKETAKDSGGEPPSMTQLLRR

SEQ ID NO: 41645 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKSGVSNKDIEKETAKDSGSEPPSMTQLLRR

SEQ ID NO: 41646 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKSGVSNKDIEKETAKDSGAEPPSMTQLLRR

SEQ ID NO: 41647 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKSGVSNKDIEKETAKDSSGEPPSMTQLLRR

SEQ ID NO: 41648 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKSGVSNKDIEKETAKDSSSEPPSMTQLLRR

SEQ ID NO: 41649 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKSGVSNKDIEKETAKDSSAEPPSMTQLLRR

SEQ ID NO: 41650 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKSGVSNKDIEKETAKDSAGEPPSMTQLLRR

SEQ ID NO: 41651 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKSGVSNKDIEKETAKDSASEPPSMTQLLRR

SEQ ID NO: 41652 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKSGVSNKDIEKETAKDSAAEPPSMTQLLRR

SEQ ID NO: 41653 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKSGVSNKDIEKETAKDAGGEPPSMTQLLRR

SEQ ID NO: 41654 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKSGVSNKDIEKETAKDAGSEPPSMTQLLRR

SEQ ID NO: 41655 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKSGVSNKDIEKETAKDAGAEPPSMTQLLRR

SEQ ID NO: 41656 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKSGVSNKDIEKETAKDASGEPPSMTQLLRR

SEQ ID NO: 41657 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKSGVSNKDIEKETAKDASSEPPSMTQLLRR

SEQ ID NO: 41658 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKSGVSNKDIEKETAKDASAEPPSMTQLLRR

SEQ ID NO: 41659 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKSGVSNKDIEKETAKDAAGEPPSMTQLLRR

SEQ ID NO: 41660 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKSGVSNKDIEKETAKDAASEPPSMTQLLRR

SEQ ID NO: 41661 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKSGVSNKDIEKETAKDAAAEPPSMTQLLRR

SEQ ID NO: 41662 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKAGVSNKDIEKETAKDGGGEPPSMTQLLRR

SEQ ID NO: 41663 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKAGVSNKDIEKETAKDGGSEPPSMTQLLRR

SEQ ID NO: 41664 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKAGVSNKDIEKETAKDGGAEPPSMTQLLRR

SEQ ID NO: 41665 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKAGVSNKDIEKETAKDGSGEPPSMTQLLRR

SEQ ID NO: 41666 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKAGVSNKDIEKETAKDGSSEPPSMTQLLRR

SEQ ID NO: 41667 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKAGVSNKDIEKETAKDGSAEPPSMTQLLRR

SEQ ID NO: 41668 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKAGVSNKDIEKETAKDGAGEPPSMTQLLRR

SEQ ID NO: 41669 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKAGVSNKDIEKETAKDGASEPPSMTQLLRR

SEQ ID NO: 41670 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKAGVSNKDIEKETAKDGAAEPPSMTQLLRR

SEQ ID NO: 41671 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKAGVSNKDIEKETAKDSGGEPPSMTQLLRR

SEQ ID NO: 41672 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKAGVSNKDIEKETAKDSGSEPPSMTQLLRR

SEQ ID NO: 41673 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKAGVSNKDIEKETAKDSGAEPPSMTQLLRR

SEQ ID NO: 41674 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKAGVSNKDIEKETAKDSSGEPPSMTQLLRR

SEQ ID NO: 41675 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKAGVSNKDIEKETAKDSSSEPPSMTQLLRR

SEQ ID NO: 41676 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKAGVSNKDIEKETAKDSSAEPPSMTQLLRR

SEQ ID NO: 41677 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKAGVSNKDIEKETAKDSAGEPPSMTQLLRR

SEQ ID NO: 41678 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKAGVSNKDIEKETAKDSASEPPSMTQLLRR

SEQ ID NO: 41679 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKAGVSNKDIEKETAKDSAAEPPSMTQLLRR

SEQ ID NO: 41680 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKAGVSNKDIEKETAKDAGGEPPSMTQLLRR

SEQ ID NO: 41681 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKAGVSNKDIEKETAKDAGSEPPSMTQLLRR

SEQ ID NO: 41682 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKAGVSNKDIEKETAKDAGAEPPSMTQLLRR

SEQ ID NO: 41683 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKAGVSNKDIEKETAKDASGEPPSMTQLLRR

SEQ ID NO: 41684 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKAGVSNKDIEKETAKDASSEPPSMTQLLRR

SEQ ID NO: 41685 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKAGVSNKDIEKETAKDASAEPPSMTQLLRR

SEQ ID NO: 41686 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKAGVSNKDIEKETAKDAAGEPPSMTQLLRR

SEQ ID NO: 41687 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKAGVSNKDIEKETAKDAASEPPSMTQLLRR

SEQ ID NO: 41688 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKAGVSNKDIEKETAKDAAAEPPSMTQLLRR

SEQ ID NO: 41689 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKGGVSNKDIEKETAKDGGGEPPSMTQLLRR

SEQ ID NO: 41690 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKGGVSNKDIEKETAKDGGSEPPSMTQLLRR

SEQ ID NO: 41691 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKGGVSNKDIEKETAKDGGAEPPSMTQLLRR

SEQ ID NO: 41692 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKGGVSNKDIEKETAKDGSGEPPSMTQLLRR

SEQ ID NO: 41693 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKGGVSNKDIEKETAKDGSSEPPSMTQLLRR

SEQ ID NO: 41694 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKGGVSNKDIEKETAKDGSAEPPSMTQLLRR

SEQ ID NO: 41695 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKGGVSNKDIEKETAKDGAGEPPSMTQLLRR

SEQ ID NO: 41696 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKGGVSNKDIEKETAKDGASEPPSMTQLLRR

SEQ ID NO: 41697 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKGGVSNKDIEKETAKDGAAEPPSMTQLLRR

SEQ ID NO: 41698 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKGGVSNKDIEKETAKDSGGEPPSMTQLLRR

SEQ ID NO: 41699 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKGGVSNKDIEKETAKDSGSEPPSMTQLLRR

SEQ ID NO: 41700 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKGGVSNKDIEKETAKDSGAEPPSMTQLLRR

SEQ ID NO: 41701 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKGGVSNKDIEKETAKDSSGEPPSMTQLLRR

SEQ ID NO: 41702 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKGGVSNKDIEKETAKDSSSEPPSMTQLLRR

SEQ ID NO: 41703 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKGGVSNKDIEKETAKDSSAEPPSMTQLLRR

SEQ ID NO: 41704 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKGGVSNKDIEKETAKDSAGEPPSMTQLLRR

SEQ ID NO: 41705 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKGGVSNKDIEKETAKDSASEPPSMTQLLRR

SEQ ID NO: 41706 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKGGVSNKDIEKETAKDSAAEPPSMTQLLRR

SEQ ID NO: 41707 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKGGVSNKDIEKETAKDAGGEPPSMTQLLRR

SEQ ID NO: 41708 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKGGVSNKDIEKETAKDAGSEPPSMTQLLRR

SEQ ID NO: 41709 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKGGVSNKDIEKETAKDAGAEPPSMTQLLRR

SEQ ID NO: 41710 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKGGVSNKDIEKETAKDASGEPPSMTQLLRR

SEQ ID NO: 41711 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKGGVSNKDIEKETAKDASSEPPSMTQLLRR

SEQ ID NO: 41712 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKGGVSNKDIEKETAKDASAEPPSMTQLLRR

SEQ ID NO: 41713 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKGGVSNKDIEKETAKDAAGEPPSMTQLLRR

SEQ ID NO: 41714 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKGGVSNKDIEKETAKDAASEPPSMTQLLRR

SEQ ID NO: 41715 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKGGVSNKDIEKETAKDAAAEPPSMTQLLRR

SEQ ID NO: 41716 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKDGVSNKDIEKETAKDGGGEPPSMTQLLRR

SEQ ID NO: 41717 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKDGVSNKDIEKETAKDGGSEPPSMTQLLRR

SEQ ID NO: 41718 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKDGVSNKDIEKETAKDGGAEPPSMTQLLRR

SEQ ID NO: 41719 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKDGVSNKDIEKETAKDGSGEPPSMTQLLRR

SEQ ID NO: 41720 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKDGVSNKDIEKETAKDGSSEPPSMTQLLRR

SEQ ID NO: 41721 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKDGVSNKDIEKETAKDGSAEPPSMTQLLRR

SEQ ID NO: 41722 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKDGVSNKDIEKETAKDGAGEPPSMTQLLRR

SEQ ID NO: 41723 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKDGVSNKDIEKETAKDGASEPPSMTQLLRR

SEQ ID NO: 41724 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKDGVSNKDIEKETAKDGAAEPPSMTQLLRR

SEQ ID NO: 41725 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKDGVSNKDIEKETAKDSGGEPPSMTQLLRR

SEQ ID NO: 41726 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKDGVSNKDIEKETAKDSGSEPPSMTQLLRR

SEQ ID NO: 41727 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKDGVSNKDIEKETAKDSGAEPPSMTQLLRR

SEQ ID NO: 41728 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKDGVSNKDIEKETAKDSSGEPPSMTQLLRR

SEQ ID NO: 41729 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKDGVSNKDIEKETAKDSSSEPPSMTQLLRR

SEQ ID NO: 41730 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKDGVSNKDIEKETAKDSSAEPPSMTQLLRR

SEQ ID NO: 41731 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKDGVSNKDIEKETAKDSAGEPPSMTQLLRR

SEQ ID NO: 41732 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKDGVSNKDIEKETAKDSASEPPSMTQLLRR

SEQ ID NO: 41733 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKDGVSNKDIEKETAKDSAAEPPSMTQLLRR

SEQ ID NO: 41734 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKDGVSNKDIEKETAKDAGGEPPSMTQLLRR

SEQ ID NO: 41735 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKDGVSNKDIEKETAKDAGSEPPSMTQLLRR

SEQ ID NO: 41736 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKDGVSNKDIEKETAKDAGAEPPSMTQLLRR

SEQ ID NO: 41737 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKDGVSNKDIEKETAKDASGEPPSMTQLLRR

SEQ ID NO: 41738 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKDGVSNKDIEKETAKDASSEPPSMTQLLRR

SEQ ID NO: 41739 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKDGVSNKDIEKETAKDASAEPPSMTQLLRR

SEQ ID NO: 41740 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKDGVSNKDIEKETAKDAAGEPPSMTQLLRR

SEQ ID NO: 41741 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKDGVSNKDIEKETAKDAASEPPSMTQLLRR

SEQ ID NO: 41742 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKDGVSNKDIEKETAKDAAAEPPSMTQLLRR

SEQ ID NO: 41743 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKHGVSNKDIEKETAKDGGGEPPSMTQLLRR

SEQ ID NO: 41744 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKHGVSNKDIEKETAKDGGSEPPSMTQLLRR

SEQ ID NO: 41745 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKHGVSNKDIEKETAKDGGAEPPSMTQLLRR

SEQ ID NO: 41746 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKHGVSNKDIEKETAKDGSGEPPSMTQLLRR

SEQ ID NO: 41747 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKHGVSNKDIEKETAKDGSSEPPSMTQLLRR

SEQ ID NO: 41748 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKHGVSNKDIEKETAKDGSAEPPSMTQLLRR

SEQ ID NO: 41749 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKHGVSNKDIEKETAKDGAGEPPSMTQLLRR

SEQ ID NO: 41750 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKHGVSNKDIEKETAKDGASEPPSMTQLLRR

SEQ ID NO: 41751 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKHGVSNKDIEKETAKDGAAEPPSMTQLLRR

SEQ ID NO: 41752 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKHGVSNKDIEKETAKDSGGEPPSMTQLLRR

SEQ ID NO: 41753 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKHGVSNKDIEKETAKDSGSEPPSMTQLLRR

SEQ ID NO: 41754 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKHGVSNKDIEKETAKDSGAEPPSMTQLLRR

SEQ ID NO: 41755 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKHGVSNKDIEKETAKDSSGEPPSMTQLLRR

SEQ ID NO: 41756 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKHGVSNKDIEKETAKDSSSEPPSMTQLLRR

SEQ ID NO: 41757 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKHGVSNKDIEKETAKDSSAEPPSMTQLLRR

SEQ ID NO: 41758 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKHGVSNKDIEKETAKDSAGEPPSMTQLLRR

SEQ ID NO: 41759 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKHGVSNKDIEKETAKDSASEPPSMTQLLRR

SEQ ID NO: 41760 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKHGVSNKDIEKETAKDSAAEPPSMTQLLRR

SEQ ID NO: 41761 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKHGVSNKDIEKETAKDAGGEPPSMTQLLRR

SEQ ID NO: 41762 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKHGVSNKDIEKETAKDAGSEPPSMTQLLRR

SEQ ID NO: 41763 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKHGVSNKDIEKETAKDAGAEPPSMTQLLRR

SEQ ID NO: 41764 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKHGVSNKDIEKETAKDASGEPPSMTQLLRR

SEQ ID NO: 41765 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKHGVSNKDIEKETAKDASSEPPSMTQLLRR

SEQ ID NO: 41766 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKHGVSNKDIEKETAKDASAEPPSMTQLLRR

SEQ ID NO: 41767 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKHGVSNKDIEKETAKDAAGEPPSMTQLLRR

SEQ ID NO: 41768 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKHGVSNKDIEKETAKDAASEPPSMTQLLRR

SEQ ID NO: 41769 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKHGVSNKDIEKETAKDAAAEPPSMTQLLRR

SEQ ID NO: 41770 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKYGVSNKDIEKETAKDGGGEPPSMTQLLRR

SEQ ID NO: 41771 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKYGVSNKDIEKETAKDGGSEPPSMTQLLRR

SEQ ID NO: 41772 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKYGVSNKDIEKETAKDGGAEPPSMTQLLRR

SEQ ID NO: 41773 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKYGVSNKDIEKETAKDGSGEPPSMTQLLRR

SEQ ID NO: 41774 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKYGVSNKDIEKETAKDGSSEPPSMTQLLRR

SEQ ID NO: 41775 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKYGVSNKDIEKETAKDGSAEPPSMTQLLRR

SEQ ID NO: 41776 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKYGVSNKDIEKETAKDGAGEPPSMTQLLRR

SEQ ID NO: 41777 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKYGVSNKDIEKETAKDGASEPPSMTQLLRR

SEQ ID NO: 41778 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKYGVSNKDIEKETAKDGAAEPPSMTQLLRR

SEQ ID NO: 41779 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKYGVSNKDIEKETAKDSGGEPPSMTQLLRR

SEQ ID NO: 41780 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKYGVSNKDIEKETAKDSGSEPPSMTQLLRR

SEQ ID NO: 41781 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKYGVSNKDIEKETAKDSGAEPPSMTQLLRR

SEQ ID NO: 41782 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKYGVSNKDIEKETAKDSSGEPPSMTQLLRR

SEQ ID NO: 41783 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKYGVSNKDIEKETAKDSSSEPPSMTQLLRR

SEQ ID NO: 41784 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKYGVSNKDIEKETAKDSSAEPPSMTQLLRR

SEQ ID NO: 41785 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKYGVSNKDIEKETAKDSAGEPPSMTQLLRR

SEQ ID NO: 41786 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKYGVSNKDIEKETAKDSASEPPSMTQLLRR

SEQ ID NO: 41787 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKYGVSNKDIEKETAKDSAAEPPSMTQLLRR

SEQ ID NO: 41788 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKYGVSNKDIEKETAKDAGGEPPSMTQLLRR

SEQ ID NO: 41789 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKYGVSNKDIEKETAKDAGSEPPSMTQLLRR

SEQ ID NO: 41790 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKYGVSNKDIEKETAKDAGAEPPSMTQLLRR

SEQ ID NO: 41791 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKYGVSNKDIEKETAKDASGEPPSMTQLLRR

SEQ ID NO: 41792 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKYGVSNKDIEKETAKDASSEPPSMTQLLRR

SEQ ID NO: 41793 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKYGVSNKDIEKETAKDASAEPPSMTQLLRR

SEQ ID NO: 41794 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKYGVSNKDIEKETAKDAAGEPPSMTQLLRR

SEQ ID NO: 41795 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKYGVSNKDIEKETAKDAASEPPSMTQLLRR

SEQ ID NO: 41796 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKYGVSNKDIEKETAKDAAAEPPSMTQLLRR

SEQ ID NO: 41797 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKKGVSNKDIEKETAKDGGGEPPSMTQLLRR

SEQ ID NO: 41798 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKKGVSNKDIEKETAKDGGSEPPSMTQLLRR

SEQ ID NO: 41799 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKKGVSNKDIEKETAKDGGAEPPSMTQLLRR

SEQ ID NO: 41800 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKKGVSNKDIEKETAKDGSGEPPSMTQLLRR

SEQ ID NO: 41801 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKKGVSNKDIEKETAKDGSSEPPSMTQLLRR

SEQ ID NO: 41802 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKKGVSNKDIEKETAKDGSAEPPSMTQLLRR

SEQ ID NO: 41803 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKKGVSNKDIEKETAKDGAGEPPSMTQLLRR

SEQ ID NO: 41804 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKKGVSNKDIEKETAKDGASEPPSMTQLLRR

SEQ ID NO: 41805 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKKGVSNKDIEKETAKDGAAEPPSMTQLLRR

SEQ ID NO: 41806 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKKGVSNKDIEKETAKDSGGEPPSMTQLLRR

SEQ ID NO: 41807 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKKGVSNKDIEKETAKDSGSEPPSMTQLLRR

SEQ ID NO: 41808 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKKGVSNKDIEKETAKDSGAEPPSMTQLLRR

SEQ ID NO: 41809 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKKGVSNKDIEKETAKDSSGEPPSMTQLLRR

SEQ ID NO: 41810 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKKGVSNKDIEKETAKDSSSEPPSMTQLLRR

SEQ ID NO: 41811 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKKGVSNKDIEKETAKDSSAEPPSMTQLLRR

SEQ ID NO: 41812 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKKGVSNKDIEKETAKDSAGEPPSMTQLLRR

SEQ ID NO: 41813 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKKGVSNKDIEKETAKDSASEPPSMTQLLRR

SEQ ID NO: 41814 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKKGVSNKDIEKETAKDSAAEPPSMTQLLRR

SEQ ID NO: 41815 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKKGVSNKDIEKETAKDAGGEPPSMTQLLRR

SEQ ID NO: 41816 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKKGVSNKDIEKETAKDAGSEPPSMTQLLRR

SEQ ID NO: 41817 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKKGVSNKDIEKETAKDAGAEPPSMTQLLRR

SEQ ID NO: 41818 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKKGVSNKDIEKETAKDASGEPPSMTQLLRR

SEQ ID NO: 41819 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKKGVSNKDIEKETAKDASSEPPSMTQLLRR

SEQ ID NO: 41820 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKKGVSNKDIEKETAKDASAEPPSMTQLLRR

SEQ ID NO: 41821 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKKGVSNKDIEKETAKDAAGEPPSMTQLLRR

SEQ ID NO: 41822 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKKGVSNKDIEKETAKDAASEPPSMTQLLRR

SEQ ID NO: 41823 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKKGVSNKDIEKETAKDAAAEPPSMTQLLRR

SEQ ID NO: 41824 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKNGVSNKDIEKETAKDGGGEPPSMTQLLRR

SEQ ID NO: 41825 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKNGVSNKDIEKETAKDGGSEPPSMTQLLRR

SEQ ID NO: 41826 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKNGVSNKDIEKETAKDGGAEPPSMTQLLRR

SEQ ID NO: 41827 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKNGVSNKDIEKETAKDGSGEPPSMTQLLRR

SEQ ID NO: 41828 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKNGVSNKDIEKETAKDGSSEPPSMTQLLRR

SEQ ID NO: 41829 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKNGVSNKDIEKETAKDGSAEPPSMTQLLRR

SEQ ID NO: 41830 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKNGVSNKDIEKETAKDGAGEPPSMTQLLRR

SEQ ID NO: 41831 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKNGVSNKDIEKETAKDGASEPPSMTQLLRR

SEQ ID NO: 41832 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKNGVSNKDIEKETAKDGAAEPPSMTQLLRR

SEQ ID NO: 41833 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKNGVSNKDIEKETAKDSGGEPPSMTQLLRR

SEQ ID NO: 41834 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKNGVSNKDIEKETAKDSGSEPPSMTQLLRR

SEQ ID NO: 41835 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKNGVSNKDIEKETAKDSGAEPPSMTQLLRR

SEQ ID NO: 41836 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKNGVSNKDIEKETAKDSSGEPPSMTQLLRR

SEQ ID NO: 41837 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKNGVSNKDIEKETAKDSSSEPPSMTQLLRR

SEQ ID NO: 41838 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKNGVSNKDIEKETAKDSSAEPPSMTQLLRR

SEQ ID NO: 41839 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKNGVSNKDIEKETAKDSAGEPPSMTQLLRR

SEQ ID NO: 41840 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKNGVSNKDIEKETAKDSASEPPSMTQLLRR

SEQ ID NO: 41841 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKNGVSNKDIEKETAKDSAAEPPSMTQLLRR

SEQ ID NO: 41842 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKNGVSNKDIEKETAKDAGGEPPSMTQLLRR

SEQ ID NO: 41843 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKNGVSNKDIEKETAKDAGSEPPSMTQLLRR

SEQ ID NO: 41844 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKNGVSNKDIEKETAKDAGAEPPSMTQLLRR

SEQ ID NO: 41845 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKNGVSNKDIEKETAKDASGEPPSMTQLLRR

SEQ ID NO: 41846 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKNGVSNKDIEKETAKDASSEPPSMTQLLRR

SEQ ID NO: 41847 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKNGVSNKDIEKETAKDASAEPPSMTQLLRR

SEQ ID NO: 41848 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKNGVSNKDIEKETAKDAAGEPPSMTQLLRR

SEQ ID NO: 41849 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKNGVSNKDIEKETAKDAASEPPSMTQLLRR

SEQ ID NO: 41850 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKNGVSNKDIEKETAKDAAAEPPSMTQLLRR

SEQ ID NO: 41851 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKMGVSNKDIEKETAKDGGGEPPSMTQLLRR

SEQ ID NO: 41852 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKMGVSNKDIEKETAKDGGSEPPSMTQLLRR

SEQ ID NO: 41853 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKMGVSNKDIEKETAKDGGAEPPSMTQLLRR

SEQ ID NO: 41854 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKMGVSNKDIEKETAKDGSGEPPSMTQLLRR

SEQ ID NO: 41855 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKMGVSNKDIEKETAKDGSSEPPSMTQLLRR

SEQ ID NO: 41856 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKMGVSNKDIEKETAKDGSAEPPSMTQLLRR

SEQ ID NO: 41857 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKMGVSNKDIEKETAKDGAGEPPSMTQLLRR

SEQ ID NO: 41858 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKMGVSNKDIEKETAKDGASEPPSMTQLLRR

SEQ ID NO: 41859 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKMGVSNKDIEKETAKDGAAEPPSMTQLLRR

SEQ ID NO: 41860 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKMGVSNKDIEKETAKDSGGEPPSMTQLLRR

SEQ ID NO: 41861 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKMGVSNKDIEKETAKDSGSEPPSMTQLLRR

SEQ ID NO: 41862 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKMGVSNKDIEKETAKDSGAEPPSMTQLLRR

SEQ ID NO: 41863 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKMGVSNKDIEKETAKDSSGEPPSMTQLLRR

SEQ ID NO: 41864 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKMGVSNKDIEKETAKDSSSEPPSMTQLLRR

SEQ ID NO: 41865 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKMGVSNKDIEKETAKDSSAEPPSMTQLLRR

SEQ ID NO: 41866 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKMGVSNKDIEKETAKDSAGEPPSMTQLLRR

SEQ ID NO: 41867 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKMGVSNKDIEKETAKDSASEPPSMTQLLRR

SEQ ID NO: 41868 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKMGVSNKDIEKETAKDSAAEPPSMTQLLRR

SEQ ID NO: 41869 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKMGVSNKDIEKETAKDAGGEPPSMTQLLRR

SEQ ID NO: 41870 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKMGVSNKDIEKETAKDAGSEPPSMTQLLRR

SEQ ID NO: 41871 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKMGVSNKDIEKETAKDAGAEPPSMTQLLRR

SEQ ID NO: 41872 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKMGVSNKDIEKETAKDASGEPPSMTQLLRR

SEQ ID NO: 41873 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKMGVSNKDIEKETAKDASSEPPSMTQLLRR

SEQ ID NO: 41874 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKMGVSNKDIEKETAKDASAEPPSMTQLLRR

SEQ ID NO: 41875 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKMGVSNKDIEKETAKDAAGEPPSMTQLLRR

SEQ ID NO: 41876 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKMGVSNKDIEKETAKDAASEPPSMTQLLRR

SEQ ID NO: 41877 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKMGVSNKDIEKETAKDAAAEPPSMTQLLRR

SEQ ID NO: 41878 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKCGVSNKDIEKETAKDGGGEPPSMTQLLRR

SEQ ID NO: 41879 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKCGVSNKDIEKETAKDGGSEPPSMTQLLRR

SEQ ID NO: 41880 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKCGVSNKDIEKETAKDGGAEPPSMTQLLRR

SEQ ID NO: 41881 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKCGVSNKDIEKETAKDGSGEPPSMTQLLRR

SEQ ID NO: 41882 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKCGVSNKDIEKETAKDGSSEPPSMTQLLRR

SEQ ID NO: 41883 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKCGVSNKDIEKETAKDGSAEPPSMTQLLRR

SEQ ID NO: 41884 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKCGVSNKDIEKETAKDGAGEPPSMTQLLRR

SEQ ID NO: 41885 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKCGVSNKDIEKETAKDGASEPPSMTQLLRR

SEQ ID NO: 41886 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKCGVSNKDIEKETAKDGAAEPPSMTQLLRR

SEQ ID NO: 41887 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKCGVSNKDIEKETAKDSGGEPPSMTQLLRR

SEQ ID NO: 41888 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKCGVSNKDIEKETAKDSGSEPPSMTQLLRR

SEQ ID NO: 41889 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKCGVSNKDIEKETAKDSGAEPPSMTQLLRR

SEQ ID NO: 41890 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKCGVSNKDIEKETAKDSSGEPPSMTQLLRR

SEQ ID NO: 41891 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKCGVSNKDIEKETAKDSSSEPPSMTQLLRR

SEQ ID NO: 41892 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKCGVSNKDIEKETAKDSSAEPPSMTQLLRR

SEQ ID NO: 41893 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKCGVSNKDIEKETAKDSAGEPPSMTQLLRR

SEQ ID NO: 41894 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKCGVSNKDIEKETAKDSASEPPSMTQLLRR

SEQ ID NO: 41895 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKCGVSNKDIEKETAKDSAAEPPSMTQLLRR

SEQ ID NO: 41896 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKCGVSNKDIEKETAKDAGGEPPSMTQLLRR

SEQ ID NO: 41897 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKCGVSNKDIEKETAKDAGSEPPSMTQLLRR

SEQ ID NO: 41898 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKCGVSNKDIEKETAKDAGAEPPSMTQLLRR

SEQ ID NO: 41899 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKCGVSNKDIEKETAKDASGEPPSMTQLLRR

SEQ ID NO: 41900 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKCGVSNKDIEKETAKDASSEPPSMTQLLRR

SEQ ID NO: 41901 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKCGVSNKDIEKETAKDASAEPPSMTQLLRR

SEQ ID NO: 41902 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKCGVSNKDIEKETAKDAAGEPPSMTQLLRR

SEQ ID NO: 41903 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKCGVSNKDIEKETAKDAASEPPSMTQLLRR

SEQ ID NO: 41904 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKCGVSNKDIEKETAKDAAAEPPSMTQLLRR

SEQ ID NO: 41905 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKSGVSNKDIEKETAKDGGGEPPSMTQLLRR

SEQ ID NO: 41906 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKSGVSNKDIEKETAKDGGSEPPSMTQLLRR

SEQ ID NO: 41907 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKSGVSNKDIEKETAKDGGAEPPSMTQLLRR

SEQ ID NO: 41908 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKSGVSNKDIEKETAKDGSGEPPSMTQLLRR

SEQ ID NO: 41909 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKSGVSNKDIEKETAKDGSSEPPSMTQLLRR

SEQ ID NO: 41910 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKSGVSNKDIEKETAKDGSAEPPSMTQLLRR

SEQ ID NO: 41911 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKSGVSNKDIEKETAKDGAGEPPSMTQLLRR

SEQ ID NO: 41912 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKSGVSNKDIEKETAKDGASEPPSMTQLLRR

SEQ ID NO: 41913 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKSGVSNKDIEKETAKDGAAEPPSMTQLLRR

SEQ ID NO: 41914 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKSGVSNKDIEKETAKDSGGEPPSMTQLLRR

SEQ ID NO: 41915 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKSGVSNKDIEKETAKDSGSEPPSMTQLLRR

SEQ ID NO: 41916 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKSGVSNKDIEKETAKDSGAEPPSMTQLLRR

SEQ ID NO: 41917 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKSGVSNKDIEKETAKDSSGEPPSMTQLLRR

SEQ ID NO: 41918 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKSGVSNKDIEKETAKDSSSEPPSMTQLLRR

SEQ ID NO: 41919 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKSGVSNKDIEKETAKDSSAEPPSMTQLLRR

SEQ ID NO: 41920 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKSGVSNKDIEKETAKDSAGEPPSMTQLLRR

SEQ ID NO: 41921 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKSGVSNKDIEKETAKDSASEPPSMTQLLRR

SEQ ID NO: 41922 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKSGVSNKDIEKETAKDSAAEPPSMTQLLRR

SEQ ID NO: 41923 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKSGVSNKDIEKETAKDAGGEPPSMTQLLRR

SEQ ID NO: 41924 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKSGVSNKDIEKETAKDAGSEPPSMTQLLRR

SEQ ID NO: 41925 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKSGVSNKDIEKETAKDAGAEPPSMTQLLRR

SEQ ID NO: 41926 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKSGVSNKDIEKETAKDASGEPPSMTQLLRR

SEQ ID NO: 41927 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKSGVSNKDIEKETAKDASSEPPSMTQLLRR

SEQ ID NO: 41928 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKSGVSNKDIEKETAKDASAEPPSMTQLLRR

SEQ ID NO: 41929 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKSGVSNKDIEKETAKDAAGEPPSMTQLLRR

SEQ ID NO: 41930 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKSGVSNKDIEKETAKDAASEPPSMTQLLRR

SEQ ID NO: 41931 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKSGVSNKDIEKETAKDAAAEPPSMTQLLRR

SEQ ID NO: 41932 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKAGVSNKDIEKETAKDGGGEPPSMTQLLRR

SEQ ID NO: 41933 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKAGVSNKDIEKETAKDGGSEPPSMTQLLRR

SEQ ID NO: 41934 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKAGVSNKDIEKETAKDGGAEPPSMTQLLRR

SEQ ID NO: 41935 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKAGVSNKDIEKETAKDGSGEPPSMTQLLRR

SEQ ID NO: 41936 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKAGVSNKDIEKETAKDGSSEPPSMTQLLRR

SEQ ID NO: 41937 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKAGVSNKDIEKETAKDGSAEPPSMTQLLRR

SEQ ID NO: 41938 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKAGVSNKDIEKETAKDGAGEPPSMTQLLRR

SEQ ID NO: 41939 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKAGVSNKDIEKETAKDGASEPPSMTQLLRR

SEQ ID NO: 41940 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKAGVSNKDIEKETAKDGAAEPPSMTQLLRR

SEQ ID NO: 41941 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKAGVSNKDIEKETAKDSGGEPPSMTQLLRR

SEQ ID NO: 41942 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKAGVSNKDIEKETAKDSGSEPPSMTQLLRR

SEQ ID NO: 41943 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKAGVSNKDIEKETAKDSGAEPPSMTQLLRR

SEQ ID NO: 41944 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKAGVSNKDIEKETAKDSSGEPPSMTQLLRR

SEQ ID NO: 41945 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKAGVSNKDIEKETAKDSSSEPPSMTQLLRR

SEQ ID NO: 41946 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKAGVSNKDIEKETAKDSSAEPPSMTQLLRR

SEQ ID NO: 41947 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKAGVSNKDIEKETAKDSAGEPPSMTQLLRR

SEQ ID NO: 41948 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKAGVSNKDIEKETAKDSASEPPSMTQLLRR

SEQ ID NO: 41949 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKAGVSNKDIEKETAKDSAAEPPSMTQLLRR

SEQ ID NO: 41950 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKAGVSNKDIEKETAKDAGGEPPSMTQLLRR

SEQ ID NO: 41951 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKAGVSNKDIEKETAKDAGSEPPSMTQLLRR

SEQ ID NO: 41952 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKAGVSNKDIEKETAKDAGAEPPSMTQLLRR

SEQ ID NO: 41953 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKAGVSNKDIEKETAKDASGEPPSMTQLLRR

SEQ ID NO: 41954 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKAGVSNKDIEKETAKDASSEPPSMTQLLRR

SEQ ID NO: 41955 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKAGVSNKDIEKETAKDASAEPPSMTQLLRR

SEQ ID NO: 41956 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKAGVSNKDIEKETAKDAAGEPPSMTQLLRR

SEQ ID NO: 41957 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKAGVSNKDIEKETAKDAASEPPSMTQLLRR

SEQ ID NO: 41958 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKAGVSNKDIEKETAKDAAAEPPSMTQLLRR

SEQ ID NO: 41959 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKGGVSNKDIEKETAKDGGGEPPSMTQLLRR

SEQ ID NO: 41960 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKGGVSNKDIEKETAKDGGSEPPSMTQLLRR

SEQ ID NO: 41961 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKGGVSNKDIEKETAKDGGAEPPSMTQLLRR

SEQ ID NO: 41962 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKGGVSNKDIEKETAKDGSGEPPSMTQLLRR

SEQ ID NO: 41963 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKGGVSNKDIEKETAKDGSSEPPSMTQLLRR

SEQ ID NO: 41964 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKGGVSNKDIEKETAKDGSAEPPSMTQLLRR

SEQ ID NO: 41965 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKGGVSNKDIEKETAKDGAGEPPSMTQLLRR

SEQ ID NO: 41966 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKGGVSNKDIEKETAKDGASEPPSMTQLLRR

SEQ ID NO: 41967 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKGGVSNKDIEKETAKDGAAEPPSMTQLLRR

SEQ ID NO: 41968 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKGGVSNKDIEKETAKDSGGEPPSMTQLLRR

SEQ ID NO: 41969 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKGGVSNKDIEKETAKDSGSEPPSMTQLLRR

SEQ ID NO: 41970 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKGGVSNKDIEKETAKDSGAEPPSMTQLLRR

SEQ ID NO: 41971 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKGGVSNKDIEKETAKDSSGEPPSMTQLLRR

SEQ ID NO: 41972 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKGGVSNKDIEKETAKDSSSEPPSMTQLLRR

SEQ ID NO: 41973 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKGGVSNKDIEKETAKDSSAEPPSMTQLLRR

SEQ ID NO: 41974 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKGGVSNKDIEKETAKDSAGEPPSMTQLLRR

SEQ ID NO: 41975 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKGGVSNKDIEKETAKDSASEPPSMTQLLRR

SEQ ID NO: 41976 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKGGVSNKDIEKETAKDSAAEPPSMTQLLRR

SEQ ID NO: 41977 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKGGVSNKDIEKETAKDAGGEPPSMTQLLRR

SEQ ID NO: 41978 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKGGVSNKDIEKETAKDAGSEPPSMTQLLRR

SEQ ID NO: 41979 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKGGVSNKDIEKETAKDAGAEPPSMTQLLRR

SEQ ID NO: 41980 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKGGVSNKDIEKETAKDASGEPPSMTQLLRR

SEQ ID NO: 41981 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKGGVSNKDIEKETAKDASSEPPSMTQLLRR

SEQ ID NO: 41982 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKGGVSNKDIEKETAKDASAEPPSMTQLLRR

SEQ ID NO: 41983 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKGGVSNKDIEKETAKDAAGEPPSMTQLLRR

SEQ ID NO: 41984 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKGGVSNKDIEKETAKDAASEPPSMTQLLRR

SEQ ID NO: 41985 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKGGVSNKDIEKETAKDAAAEPPSMTQLLRR

SEQ ID NO: 41986 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKDGVSNKDIEKETAKDGGGEPPSMTQLLRR

SEQ ID NO: 41987 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKDGVSNKDIEKETAKDGGSEPPSMTQLLRR

SEQ ID NO: 41988 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKDGVSNKDIEKETAKDGGAEPPSMTQLLRR

SEQ ID NO: 41989 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKDGVSNKDIEKETAKDGSGEPPSMTQLLRR

SEQ ID NO: 41990 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKDGVSNKDIEKETAKDGSSEPPSMTQLLRR

SEQ ID NO: 41991 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKDGVSNKDIEKETAKDGSAEPPSMTQLLRR

SEQ ID NO: 41992 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKDGVSNKDIEKETAKDGAGEPPSMTQLLRR

SEQ ID NO: 41993 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKDGVSNKDIEKETAKDGASEPPSMTQLLRR

SEQ ID NO: 41994 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKDGVSNKDIEKETAKDGAAEPPSMTQLLRR

SEQ ID NO: 41995 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKDGVSNKDIEKETAKDSGGEPPSMTQLLRR

SEQ ID NO: 41996 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKDGVSNKDIEKETAKDSGSEPPSMTQLLRR

SEQ ID NO: 41997 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKDGVSNKDIEKETAKDSGAEPPSMTQLLRR

SEQ ID NO: 41998 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKDGVSNKDIEKETAKDSSGEPPSMTQLLRR

SEQ ID NO: 41999 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKDGVSNKDIEKETAKDSSSEPPSMTQLLRR

SEQ ID NO: 42000 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKDGVSNKDIEKETAKDSSAEPPSMTQLLRR

SEQ ID NO: 42001 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKDGVSNKDIEKETAKDSAGEPPSMTQLLRR

SEQ ID NO: 42002 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKDGVSNKDIEKETAKDSASEPPSMTQLLRR

SEQ ID NO: 42003 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKDGVSNKDIEKETAKDSAAEPPSMTQLLRR

SEQ ID NO: 42004 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKDGVSNKDIEKETAKDAGGEPPSMTQLLRR

SEQ ID NO: 42005 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKDGVSNKDIEKETAKDAGSEPPSMTQLLRR

SEQ ID NO: 42006 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKDGVSNKDIEKETAKDAGAEPPSMTQLLRR

SEQ ID NO: 42007 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKDGVSNKDIEKETAKDASGEPPSMTQLLRR

SEQ ID NO: 42008 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKDGVSNKDIEKETAKDASSEPPSMTQLLRR

SEQ ID NO: 42009 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKDGVSNKDIEKETAKDASAEPPSMTQLLRR

SEQ ID NO: 42010 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKDGVSNKDIEKETAKDAAGEPPSMTQLLRR

SEQ ID NO: 42011 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKDGVSNKDIEKETAKDAASEPPSMTQLLRR

SEQ ID NO: 42012 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKDGVSNKDIEKETAKDAAAEPPSMTQLLRR

SEQ ID NO: 42013 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKHGVSNKDIEKETAKDGGGEPPSMTQLLRR

SEQ ID NO: 42014 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKHGVSNKDIEKETAKDGGSEPPSMTQLLRR

SEQ ID NO: 42015 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKHGVSNKDIEKETAKDGGAEPPSMTQLLRR

SEQ ID NO: 42016 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKHGVSNKDIEKETAKDGSGEPPSMTQLLRR

SEQ ID NO: 42017 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKHGVSNKDIEKETAKDGSSEPPSMTQLLRR

SEQ ID NO: 42018 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKHGVSNKDIEKETAKDGSAEPPSMTQLLRR

SEQ ID NO: 42019 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKHGVSNKDIEKETAKDGAGEPPSMTQLLRR

SEQ ID NO: 42020 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKHGVSNKDIEKETAKDGASEPPSMTQLLRR

SEQ ID NO: 42021 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKHGVSNKDIEKETAKDGAAEPPSMTQLLRR

SEQ ID NO: 42022 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKHGVSNKDIEKETAKDSGGEPPSMTQLLRR

SEQ ID NO: 42023 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKHGVSNKDIEKETAKDSGSEPPSMTQLLRR

SEQ ID NO: 42024 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKHGVSNKDIEKETAKDSGAEPPSMTQLLRR

SEQ ID NO: 42025 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKHGVSNKDIEKETAKDSSGEPPSMTQLLRR

SEQ ID NO: 42026 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKHGVSNKDIEKETAKDSSSEPPSMTQLLRR

SEQ ID NO: 42027 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKHGVSNKDIEKETAKDSSAEPPSMTQLLRR

SEQ ID NO: 42028 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKHGVSNKDIEKETAKDSAGEPPSMTQLLRR

SEQ ID NO: 42029 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKHGVSNKDIEKETAKDSASEPPSMTQLLRR

SEQ ID NO: 42030 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKHGVSNKDIEKETAKDSAAEPPSMTQLLRR

SEQ ID NO: 42031 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKHGVSNKDIEKETAKDAGGEPPSMTQLLRR

SEQ ID NO: 42032 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKHGVSNKDIEKETAKDAGSEPPSMTQLLRR

SEQ ID NO: 42033 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKHGVSNKDIEKETAKDAGAEPPSMTQLLRR

SEQ ID NO: 42034 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKHGVSNKDIEKETAKDASGEPPSMTQLLRR

SEQ ID NO: 42035 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKHGVSNKDIEKETAKDASSEPPSMTQLLRR

SEQ ID NO: 42036 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKHGVSNKDIEKETAKDASAEPPSMTQLLRR

SEQ ID NO: 42037 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKHGVSNKDIEKETAKDAAGEPPSMTQLLRR

SEQ ID NO: 42038 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKHGVSNKDIEKETAKDAASEPPSMTQLLRR

SEQ ID NO: 42039 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKHGVSNKDIEKETAKDAAAEPPSMTQLLRR

SEQ ID NO: 42040 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKYGVSNKDIEKETAKDGGGEPPSMTQLLRR

SEQ ID NO: 42041 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKYGVSNKDIEKETAKDGGSEPPSMTQLLRR

SEQ ID NO: 42042 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKYGVSNKDIEKETAKDGGAEPPSMTQLLRR

SEQ ID NO: 42043 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKYGVSNKDIEKETAKDGSGEPPSMTQLLRR

SEQ ID NO: 42044 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKYGVSNKDIEKETAKDGSSEPPSMTQLLRR

SEQ ID NO: 42045 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKYGVSNKDIEKETAKDGSAEPPSMTQLLRR

SEQ ID NO: 42046 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKYGVSNKDIEKETAKDGAGEPPSMTQLLRR

SEQ ID NO: 42047 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKYGVSNKDIEKETAKDGASEPPSMTQLLRR

SEQ ID NO: 42048 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKYGVSNKDIEKETAKDGAAEPPSMTQLLRR

SEQ ID NO: 42049 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKYGVSNKDIEKETAKDSGGEPPSMTQLLRR

SEQ ID NO: 42050 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKYGVSNKDIEKETAKDSGSEPPSMTQLLRR

SEQ ID NO: 42051 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKYGVSNKDIEKETAKDSGAEPPSMTQLLRR

SEQ ID NO: 42052 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKYGVSNKDIEKETAKDSSGEPPSMTQLLRR

SEQ ID NO: 42053 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKYGVSNKDIEKETAKDSSSEPPSMTQLLRR

SEQ ID NO: 42054 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKYGVSNKDIEKETAKDSSAEPPSMTQLLRR

SEQ ID NO: 42055 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKYGVSNKDIEKETAKDSAGEPPSMTQLLRR

SEQ ID NO: 42056 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKYGVSNKDIEKETAKDSASEPPSMTQLLRR

SEQ ID NO: 42057 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKYGVSNKDIEKETAKDSAAEPPSMTQLLRR

SEQ ID NO: 42058 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKYGVSNKDIEKETAKDAGGEPPSMTQLLRR

SEQ ID NO: 42059 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKYGVSNKDIEKETAKDAGSEPPSMTQLLRR

SEQ ID NO: 42060 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKYGVSNKDIEKETAKDAGAEPPSMTQLLRR

SEQ ID NO: 42061 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKYGVSNKDIEKETAKDASGEPPSMTQLLRR

SEQ ID NO: 42062 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKYGVSNKDIEKETAKDASSEPPSMTQLLRR

SEQ ID NO: 42063 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKYGVSNKDIEKETAKDASAEPPSMTQLLRR

SEQ ID NO: 42064 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKYGVSNKDIEKETAKDAAGEPPSMTQLLRR

SEQ ID NO: 42065 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKYGVSNKDIEKETAKDAASEPPSMTQLLRR

SEQ ID NO: 42066 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKYGVSNKDIEKETAKDAAAEPPSMTQLLRR

SEQ ID NO: 42067 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKKGVSNKDIEKETAKDGGGEPPSMTQLLRR

SEQ ID NO: 42068 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKKGVSNKDIEKETAKDGGSEPPSMTQLLRR

SEQ ID NO: 42069 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKKGVSNKDIEKETAKDGGAEPPSMTQLLRR

SEQ ID NO: 42070 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKKGVSNKDIEKETAKDGSGEPPSMTQLLRR

SEQ ID NO: 42071 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKKGVSNKDIEKETAKDGSSEPPSMTQLLRR

SEQ ID NO: 42072 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKKGVSNKDIEKETAKDGSAEPPSMTQLLRR

SEQ ID NO: 42073 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKKGVSNKDIEKETAKDGAGEPPSMTQLLRR

SEQ ID NO: 42074 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKKGVSNKDIEKETAKDGASEPPSMTQLLRR

SEQ ID NO: 42075 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKKGVSNKDIEKETAKDGAAEPPSMTQLLRR

SEQ ID NO: 42076 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKKGVSNKDIEKETAKDSGGEPPSMTQLLRR

SEQ ID NO: 42077 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKKGVSNKDIEKETAKDSGSEPPSMTQLLRR

SEQ ID NO: 42078 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKKGVSNKDIEKETAKDSGAEPPSMTQLLRR

SEQ ID NO: 42079 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKKGVSNKDIEKETAKDSSGEPPSMTQLLRR

SEQ ID NO: 42080 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKKGVSNKDIEKETAKDSSSEPPSMTQLLRR

SEQ ID NO: 42081 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKKGVSNKDIEKETAKDSSAEPPSMTQLLRR

SEQ ID NO: 42082 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKKGVSNKDIEKETAKDSAGEPPSMTQLLRR

SEQ ID NO: 42083 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKKGVSNKDIEKETAKDSASEPPSMTQLLRR

SEQ ID NO: 42084 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKKGVSNKDIEKETAKDSAAEPPSMTQLLRR

SEQ ID NO: 42085 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKKGVSNKDIEKETAKDAGGEPPSMTQLLRR

SEQ ID NO: 42086 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKKGVSNKDIEKETAKDAGSEPPSMTQLLRR

SEQ ID NO: 42087 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKKGVSNKDIEKETAKDAGAEPPSMTQLLRR

SEQ ID NO: 42088 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKKGVSNKDIEKETAKDASGEPPSMTQLLRR

SEQ ID NO: 42089 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKKGVSNKDIEKETAKDASSEPPSMTQLLRR

SEQ ID NO: 42090 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKKGVSNKDIEKETAKDASAEPPSMTQLLRR

SEQ ID NO: 42091 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKKGVSNKDIEKETAKDAAGEPPSMTQLLRR

SEQ ID NO: 42092 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKKGVSNKDIEKETAKDAASEPPSMTQLLRR

SEQ ID NO: 42093 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKKGVSNKDIEKETAKDAAAEPPSMTQLLRR

SEQ ID NO: 42094 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKNGVSNKDIEKETAKDGGGEPPSMTQLLRR

SEQ ID NO: 42095 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKNGVSNKDIEKETAKDGGSEPPSMTQLLRR

SEQ ID NO: 42096 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKNGVSNKDIEKETAKDGGAEPPSMTQLLRR

SEQ ID NO: 42097 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKNGVSNKDIEKETAKDGSGEPPSMTQLLRR

SEQ ID NO: 42098 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKNGVSNKDIEKETAKDGSSEPPSMTQLLRR

SEQ ID NO: 42099 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKNGVSNKDIEKETAKDGSAEPPSMTQLLRR

SEQ ID NO: 42100 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKNGVSNKDIEKETAKDGAGEPPSMTQLLRR

SEQ ID NO: 42101 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKNGVSNKDIEKETAKDGASEPPSMTQLLRR

SEQ ID NO: 42102 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKNGVSNKDIEKETAKDGAAEPPSMTQLLRR

SEQ ID NO: 42103 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKNGVSNKDIEKETAKDSGGEPPSMTQLLRR

SEQ ID NO: 42104 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKNGVSNKDIEKETAKDSGSEPPSMTQLLRR

SEQ ID NO: 42105 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKNGVSNKDIEKETAKDSGAEPPSMTQLLRR

SEQ ID NO: 42106 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKNGVSNKDIEKETAKDSSGEPPSMTQLLRR

SEQ ID NO: 42107 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKNGVSNKDIEKETAKDSSSEPPSMTQLLRR

SEQ ID NO: 42108 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKNGVSNKDIEKETAKDSSAEPPSMTQLLRR

SEQ ID NO: 42109 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKNGVSNKDIEKETAKDSAGEPPSMTQLLRR

SEQ ID NO: 42110 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKNGVSNKDIEKETAKDSASEPPSMTQLLRR

SEQ ID NO: 42111 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKNGVSNKDIEKETAKDSAAEPPSMTQLLRR

SEQ ID NO: 42112 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKNGVSNKDIEKETAKDAGGEPPSMTQLLRR

SEQ ID NO: 42113 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKNGVSNKDIEKETAKDAGSEPPSMTQLLRR

SEQ ID NO: 42114 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKNGVSNKDIEKETAKDAGAEPPSMTQLLRR

SEQ ID NO: 42115 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKNGVSNKDIEKETAKDASGEPPSMTQLLRR

SEQ ID NO: 42116 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKNGVSNKDIEKETAKDASSEPPSMTQLLRR

SEQ ID NO: 42117 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKNGVSNKDIEKETAKDASAEPPSMTQLLRR

SEQ ID NO: 42118 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKNGVSNKDIEKETAKDAAGEPPSMTQLLRR

SEQ ID NO: 42119 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKNGVSNKDIEKETAKDAASEPPSMTQLLRR

SEQ ID NO: 42120 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKNGVSNKDIEKETAKDAAAEPPSMTQLLRR

SEQ ID NO: 42121 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKMGVSNKDIEKETAKDGGGEPPSMTQLLRR

SEQ ID NO: 42122 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKMGVSNKDIEKETAKDGGSEPPSMTQLLRR

SEQ ID NO: 42123 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKMGVSNKDIEKETAKDGGAEPPSMTQLLRR

SEQ ID NO: 42124 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKMGVSNKDIEKETAKDGSGEPPSMTQLLRR

SEQ ID NO: 42125 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKMGVSNKDIEKETAKDGSSEPPSMTQLLRR

SEQ ID NO: 42126 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKMGVSNKDIEKETAKDGSAEPPSMTQLLRR

SEQ ID NO: 42127 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKMGVSNKDIEKETAKDGAGEPPSMTQLLRR

SEQ ID NO: 42128 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKMGVSNKDIEKETAKDGASEPPSMTQLLRR

SEQ ID NO: 42129 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKMGVSNKDIEKETAKDGAAEPPSMTQLLRR

SEQ ID NO: 42130 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKMGVSNKDIEKETAKDSGGEPPSMTQLLRR

SEQ ID NO: 42131 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKMGVSNKDIEKETAKDSGSEPPSMTQLLRR

SEQ ID NO: 42132 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKMGVSNKDIEKETAKDSGAEPPSMTQLLRR

SEQ ID NO: 42133 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKMGVSNKDIEKETAKDSSGEPPSMTQLLRR

SEQ ID NO: 42134 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKMGVSNKDIEKETAKDSSSEPPSMTQLLRR

SEQ ID NO: 42135 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKMGVSNKDIEKETAKDSSAEPPSMTQLLRR

SEQ ID NO: 42136 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKMGVSNKDIEKETAKDSAGEPPSMTQLLRR

SEQ ID NO: 42137 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKMGVSNKDIEKETAKDSASEPPSMTQLLRR

SEQ ID NO: 42138 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKMGVSNKDIEKETAKDSAAEPPSMTQLLRR

SEQ ID NO: 42139 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKMGVSNKDIEKETAKDAGGEPPSMTQLLRR

SEQ ID NO: 42140 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKMGVSNKDIEKETAKDAGSEPPSMTQLLRR

SEQ ID NO: 42141 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKMGVSNKDIEKETAKDAGAEPPSMTQLLRR

SEQ ID NO: 42142 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKMGVSNKDIEKETAKDASGEPPSMTQLLRR

SEQ ID NO: 42143 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKMGVSNKDIEKETAKDASSEPPSMTQLLRR

SEQ ID NO: 42144 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKMGVSNKDIEKETAKDASAEPPSMTQLLRR

SEQ ID NO: 42145 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKMGVSNKDIEKETAKDAAGEPPSMTQLLRR

SEQ ID NO: 42146 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKMGVSNKDIEKETAKDAASEPPSMTQLLRR

SEQ ID NO: 42147 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKMGVSNKDIEKETAKDAAAEPPSMTQLLRR

SEQ ID NO: 42148 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKCGVSNKDIEKETAKDGGGEPPSMTQLLRR

SEQ ID NO: 42149 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKCGVSNKDIEKETAKDGGSEPPSMTQLLRR

SEQ ID NO: 42150 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKCGVSNKDIEKETAKDGGAEPPSMTQLLRR

SEQ ID NO: 42151 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKCGVSNKDIEKETAKDGSGEPPSMTQLLRR

SEQ ID NO: 42152 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKCGVSNKDIEKETAKDGSSEPPSMTQLLRR

SEQ ID NO: 42153 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKCGVSNKDIEKETAKDGSAEPPSMTQLLRR

SEQ ID NO: 42154 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKCGVSNKDIEKETAKDGAGEPPSMTQLLRR

SEQ ID NO: 42155 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKCGVSNKDIEKETAKDGASEPPSMTQLLRR

SEQ ID NO: 42156 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKCGVSNKDIEKETAKDGAAEPPSMTQLLRR

SEQ ID NO: 42157 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKCGVSNKDIEKETAKDSGGEPPSMTQLLRR

SEQ ID NO: 42158 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKCGVSNKDIEKETAKDSGSEPPSMTQLLRR

SEQ ID NO: 42159 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKCGVSNKDIEKETAKDSGAEPPSMTQLLRR

SEQ ID NO: 42160 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKCGVSNKDIEKETAKDSSGEPPSMTQLLRR

SEQ ID NO: 42161 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKCGVSNKDIEKETAKDSSSEPPSMTQLLRR

SEQ ID NO: 42162 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKCGVSNKDIEKETAKDSSAEPPSMTQLLRR

SEQ ID NO: 42163 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKCGVSNKDIEKETAKDSAGEPPSMTQLLRR

SEQ ID NO: 42164 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKCGVSNKDIEKETAKDSASEPPSMTQLLRR

SEQ ID NO: 42165 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKCGVSNKDIEKETAKDSAAEPPSMTQLLRR

SEQ ID NO: 42166 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKCGVSNKDIEKETAKDAGGEPPSMTQLLRR

SEQ ID NO: 42167 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKCGVSNKDIEKETAKDAGSEPPSMTQLLRR

SEQ ID NO: 42168 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKCGVSNKDIEKETAKDAGAEPPSMTQLLRR

SEQ ID NO: 42169 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKCGVSNKDIEKETAKDASGEPPSMTQLLRR

SEQ ID NO: 42170 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKCGVSNKDIEKETAKDASSEPPSMTQLLRR

SEQ ID NO: 42171 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKCGVSNKDIEKETAKDASAEPPSMTQLLRR

SEQ ID NO: 42172 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKCGVSNKDIEKETAKDAAGEPPSMTQLLRR

SEQ ID NO: 42173 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKCGVSNKDIEKETAKDAASEPPSMTQLLRR

SEQ ID NO: 42174 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKCGVSNKDIEKETAKDAAAEPPSMTQLLRR

SEQ ID NO: 42175 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKSGVSNKDIEKETAKDGGGEPPSMTQLLRR

SEQ ID NO: 42176 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKSGVSNKDIEKETAKDGGSEPPSMTQLLRR

SEQ ID NO: 42177 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKSGVSNKDIEKETAKDGGAEPPSMTQLLRR

SEQ ID NO: 42178 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKSGVSNKDIEKETAKDGSGEPPSMTQLLRR

SEQ ID NO: 42179 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKSGVSNKDIEKETAKDGSSEPPSMTQLLRR

SEQ ID NO: 42180 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKSGVSNKDIEKETAKDGSAEPPSMTQLLRR

SEQ ID NO: 42181 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKSGVSNKDIEKETAKDGAGEPPSMTQLLRR

SEQ ID NO: 42182 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKSGVSNKDIEKETAKDGASEPPSMTQLLRR

SEQ ID NO: 42183 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKSGVSNKDIEKETAKDGAAEPPSMTQLLRR

SEQ ID NO: 42184 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKSGVSNKDIEKETAKDSGGEPPSMTQLLRR

SEQ ID NO: 42185 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKSGVSNKDIEKETAKDSGSEPPSMTQLLRR

SEQ ID NO: 42186 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKSGVSNKDIEKETAKDSGAEPPSMTQLLRR

SEQ ID NO: 42187 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKSGVSNKDIEKETAKDSSGEPPSMTQLLRR

SEQ ID NO: 42188 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKSGVSNKDIEKETAKDSSSEPPSMTQLLRR

SEQ ID NO: 42189 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKSGVSNKDIEKETAKDSSAEPPSMTQLLRR

SEQ ID NO: 42190 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKSGVSNKDIEKETAKDSAGEPPSMTQLLRR

SEQ ID NO: 42191 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKSGVSNKDIEKETAKDSASEPPSMTQLLRR

SEQ ID NO: 42192 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKSGVSNKDIEKETAKDSAAEPPSMTQLLRR

SEQ ID NO: 42193 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKSGVSNKDIEKETAKDAGGEPPSMTQLLRR

SEQ ID NO: 42194 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKSGVSNKDIEKETAKDAGSEPPSMTQLLRR

SEQ ID NO: 42195 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKSGVSNKDIEKETAKDAGAEPPSMTQLLRR

SEQ ID NO: 42196 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKSGVSNKDIEKETAKDASGEPPSMTQLLRR

SEQ ID NO: 42197 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKSGVSNKDIEKETAKDASSEPPSMTQLLRR

SEQ ID NO: 42198 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKSGVSNKDIEKETAKDASAEPPSMTQLLRR

SEQ ID NO: 42199 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKSGVSNKDIEKETAKDAAGEPPSMTQLLRR

SEQ ID NO: 42200 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKSGVSNKDIEKETAKDAASEPPSMTQLLRR

SEQ ID NO: 42201 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKSGVSNKDIEKETAKDAAAEPPSMTQLLRR

SEQ ID NO: 42202 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKAGVSNKDIEKETAKDGGGEPPSMTQLLRR

SEQ ID NO: 42203 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKAGVSNKDIEKETAKDGGSEPPSMTQLLRR

SEQ ID NO: 42204 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKAGVSNKDIEKETAKDGGAEPPSMTQLLRR

SEQ ID NO: 42205 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKAGVSNKDIEKETAKDGSGEPPSMTQLLRR

SEQ ID NO: 42206 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKAGVSNKDIEKETAKDGSSEPPSMTQLLRR

SEQ ID NO: 42207 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKAGVSNKDIEKETAKDGSAEPPSMTQLLRR

SEQ ID NO: 42208 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKAGVSNKDIEKETAKDGAGEPPSMTQLLRR

SEQ ID NO: 42209 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKAGVSNKDIEKETAKDGASEPPSMTQLLRR

SEQ ID NO: 42210 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKAGVSNKDIEKETAKDGAAEPPSMTQLLRR

SEQ ID NO: 42211 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKAGVSNKDIEKETAKDSGGEPPSMTQLLRR

SEQ ID NO: 42212 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKAGVSNKDIEKETAKDSGSEPPSMTQLLRR

SEQ ID NO: 42213 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKAGVSNKDIEKETAKDSGAEPPSMTQLLRR

SEQ ID NO: 42214 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKAGVSNKDIEKETAKDSSGEPPSMTQLLRR

SEQ ID NO: 42215 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKAGVSNKDIEKETAKDSSSEPPSMTQLLRR

SEQ ID NO: 42216 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKAGVSNKDIEKETAKDSSAEPPSMTQLLRR

SEQ ID NO: 42217 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKAGVSNKDIEKETAKDSAGEPPSMTQLLRR

SEQ ID NO: 42218 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKAGVSNKDIEKETAKDSASEPPSMTQLLRR

SEQ ID NO: 42219 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKAGVSNKDIEKETAKDSAAEPPSMTQLLRR

SEQ ID NO: 42220 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKAGVSNKDIEKETAKDAGGEPPSMTQLLRR

SEQ ID NO: 42221 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKAGVSNKDIEKETAKDAGSEPPSMTQLLRR

SEQ ID NO: 42222 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKAGVSNKDIEKETAKDAGAEPPSMTQLLRR

SEQ ID NO: 42223 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKAGVSNKDIEKETAKDASGEPPSMTQLLRR

SEQ ID NO: 42224 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKAGVSNKDIEKETAKDASSEPPSMTQLLRR

SEQ ID NO: 42225 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKAGVSNKDIEKETAKDASAEPPSMTQLLRR

SEQ ID NO: 42226 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKAGVSNKDIEKETAKDAAGEPPSMTQLLRR

SEQ ID NO: 42227 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKAGVSNKDIEKETAKDAASEPPSMTQLLRR

SEQ ID NO: 42228 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKAGVSNKDIEKETAKDAAAEPPSMTQLLRR

SEQ ID NO: 42229 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKGGVSNKDIEKETAKDGGGEPPSMTQLLRR

SEQ ID NO: 42230 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKGGVSNKDIEKETAKDGGSEPPSMTQLLRR

SEQ ID NO: 42231 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKGGVSNKDIEKETAKDGGAEPPSMTQLLRR

SEQ ID NO: 42232 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKGGVSNKDIEKETAKDGSGEPPSMTQLLRR

SEQ ID NO: 42233 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKGGVSNKDIEKETAKDGSSEPPSMTQLLRR

SEQ ID NO: 42234 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKGGVSNKDIEKETAKDGSAEPPSMTQLLRR

SEQ ID NO: 42235 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKGGVSNKDIEKETAKDGAGEPPSMTQLLRR

SEQ ID NO: 42236 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKGGVSNKDIEKETAKDGASEPPSMTQLLRR

SEQ ID NO: 42237 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKGGVSNKDIEKETAKDGAAEPPSMTQLLRR

SEQ ID NO: 42238 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKGGVSNKDIEKETAKDSGGEPPSMTQLLRR

SEQ ID NO: 42239 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKGGVSNKDIEKETAKDSGSEPPSMTQLLRR

SEQ ID NO: 42240 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKGGVSNKDIEKETAKDSGAEPPSMTQLLRR

SEQ ID NO: 42241 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKGGVSNKDIEKETAKDSSGEPPSMTQLLRR

SEQ ID NO: 42242 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKGGVSNKDIEKETAKDSSSEPPSMTQLLRR

SEQ ID NO: 42243 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKGGVSNKDIEKETAKDSSAEPPSMTQLLRR

SEQ ID NO: 42244 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKGGVSNKDIEKETAKDSAGEPPSMTQLLRR

SEQ ID NO: 42245 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKGGVSNKDIEKETAKDSASEPPSMTQLLRR

SEQ ID NO: 42246 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKGGVSNKDIEKETAKDSAAEPPSMTQLLRR

SEQ ID NO: 42247 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKGGVSNKDIEKETAKDAGGEPPSMTQLLRR

SEQ ID NO: 42248 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKGGVSNKDIEKETAKDAGSEPPSMTQLLRR

SEQ ID NO: 42249 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKGGVSNKDIEKETAKDAGAEPPSMTQLLRR

SEQ ID NO: 42250 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKGGVSNKDIEKETAKDASGEPPSMTQLLRR

SEQ ID NO: 42251 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKGGVSNKDIEKETAKDASSEPPSMTQLLRR

SEQ ID NO: 42252 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKGGVSNKDIEKETAKDASAEPPSMTQLLRR

SEQ ID NO: 42253 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKGGVSNKDIEKETAKDAAGEPPSMTQLLRR

SEQ ID NO: 42254 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKGGVSNKDIEKETAKDAASEPPSMTQLLRR

SEQ ID NO: 42255 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKGGVSNKDIEKETAKDAAAEPPSMTQLLRR

SEQ ID NO: 42256 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKDGVSNKDIEKETAKDGGGEPPSMTQLLRR

SEQ ID NO: 42257 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKDGVSNKDIEKETAKDGGSEPPSMTQLLRR

SEQ ID NO: 42258 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKDGVSNKDIEKETAKDGGAEPPSMTQLLRR

SEQ ID NO: 42259 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKDGVSNKDIEKETAKDGSGEPPSMTQLLRR

SEQ ID NO: 42260 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKDGVSNKDIEKETAKDGSSEPPSMTQLLRR

SEQ ID NO: 42261 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKDGVSNKDIEKETAKDGSAEPPSMTQLLRR

SEQ ID NO: 42262 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKDGVSNKDIEKETAKDGAGEPPSMTQLLRR

SEQ ID NO: 42263 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKDGVSNKDIEKETAKDGASEPPSMTQLLRR

SEQ ID NO: 42264 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKDGVSNKDIEKETAKDGAAEPPSMTQLLRR

SEQ ID NO: 42265 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKDGVSNKDIEKETAKDSGGEPPSMTQLLRR

SEQ ID NO: 42266 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKDGVSNKDIEKETAKDSGSEPPSMTQLLRR

SEQ ID NO: 42267 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKDGVSNKDIEKETAKDSGAEPPSMTQLLRR

SEQ ID NO: 42268 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKDGVSNKDIEKETAKDSSGEPPSMTQLLRR

SEQ ID NO: 42269 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKDGVSNKDIEKETAKDSSSEPPSMTQLLRR

SEQ ID NO: 42270 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKDGVSNKDIEKETAKDSSAEPPSMTQLLRR

SEQ ID NO: 42271 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKDGVSNKDIEKETAKDSAGEPPSMTQLLRR

SEQ ID NO: 42272 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKDGVSNKDIEKETAKDSASEPPSMTQLLRR

SEQ ID NO: 42273 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKDGVSNKDIEKETAKDSAAEPPSMTQLLRR

SEQ ID NO: 42274 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKDGVSNKDIEKETAKDAGGEPPSMTQLLRR

SEQ ID NO: 42275 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKDGVSNKDIEKETAKDAGSEPPSMTQLLRR

SEQ ID NO: 42276 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKDGVSNKDIEKETAKDAGAEPPSMTQLLRR

SEQ ID NO: 42277 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKDGVSNKDIEKETAKDASGEPPSMTQLLRR

SEQ ID NO: 42278 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKDGVSNKDIEKETAKDASSEPPSMTQLLRR

SEQ ID NO: 42279 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKDGVSNKDIEKETAKDASAEPPSMTQLLRR

SEQ ID NO: 42280 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKDGVSNKDIEKETAKDAAGEPPSMTQLLRR

SEQ ID NO: 42281 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKDGVSNKDIEKETAKDAASEPPSMTQLLRR

SEQ ID NO: 42282 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKDGVSNKDIEKETAKDAAAEPPSMTQLLRR

SEQ ID NO: 42283 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKHGVSNKDIEKETAKDGGGEPPSMTQLLRR

SEQ ID NO: 42284 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKHGVSNKDIEKETAKDGGSEPPSMTQLLRR

SEQ ID NO: 42285 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKHGVSNKDIEKETAKDGGAEPPSMTQLLRR

SEQ ID NO: 42286 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKHGVSNKDIEKETAKDGSGEPPSMTQLLRR

SEQ ID NO: 42287 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKHGVSNKDIEKETAKDGSSEPPSMTQLLRR

SEQ ID NO: 42288 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKHGVSNKDIEKETAKDGSAEPPSMTQLLRR

SEQ ID NO: 42289 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKHGVSNKDIEKETAKDGAGEPPSMTQLLRR

SEQ ID NO: 42290 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKHGVSNKDIEKETAKDGASEPPSMTQLLRR

SEQ ID NO: 42291 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKHGVSNKDIEKETAKDGAAEPPSMTQLLRR

SEQ ID NO: 42292 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKHGVSNKDIEKETAKDSGGEPPSMTQLLRR

SEQ ID NO: 42293 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKHGVSNKDIEKETAKDSGSEPPSMTQLLRR

SEQ ID NO: 42294 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKHGVSNKDIEKETAKDSGAEPPSMTQLLRR

SEQ ID NO: 42295 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKHGVSNKDIEKETAKDSSGEPPSMTQLLRR

SEQ ID NO: 42296 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKHGVSNKDIEKETAKDSSSEPPSMTQLLRR

SEQ ID NO: 42297 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKHGVSNKDIEKETAKDSSAEPPSMTQLLRR

SEQ ID NO: 42298 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKHGVSNKDIEKETAKDSAGEPPSMTQLLRR

SEQ ID NO: 42299 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKHGVSNKDIEKETAKDSASEPPSMTQLLRR

SEQ ID NO: 42300 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKHGVSNKDIEKETAKDSAAEPPSMTQLLRR

SEQ ID NO: 42301 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKHGVSNKDIEKETAKDAGGEPPSMTQLLRR

SEQ ID NO: 42302 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKHGVSNKDIEKETAKDAGSEPPSMTQLLRR

SEQ ID NO: 42303 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKHGVSNKDIEKETAKDAGAEPPSMTQLLRR

SEQ ID NO: 42304 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKHGVSNKDIEKETAKDASGEPPSMTQLLRR

SEQ ID NO: 42305 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKHGVSNKDIEKETAKDASSEPPSMTQLLRR

SEQ ID NO: 42306 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKHGVSNKDIEKETAKDASAEPPSMTQLLRR

SEQ ID NO: 42307 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKHGVSNKDIEKETAKDAAGEPPSMTQLLRR

SEQ ID NO: 42308 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKHGVSNKDIEKETAKDAASEPPSMTQLLRR

SEQ ID NO: 42309 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKHGVSNKDIEKETAKDAAAEPPSMTQLLRR

SEQ ID NO: 42310 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKYGVSNKDIEKETAKDGGGEPPSMTQLLRR

SEQ ID NO: 42311 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKYGVSNKDIEKETAKDGGSEPPSMTQLLRR

SEQ ID NO: 42312 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKYGVSNKDIEKETAKDGGAEPPSMTQLLRR

SEQ ID NO: 42313 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKYGVSNKDIEKETAKDGSGEPPSMTQLLRR

SEQ ID NO: 42314 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKYGVSNKDIEKETAKDGSSEPPSMTQLLRR

SEQ ID NO: 42315 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKYGVSNKDIEKETAKDGSAEPPSMTQLLRR

SEQ ID NO: 42316 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKYGVSNKDIEKETAKDGAGEPPSMTQLLRR

SEQ ID NO: 42317 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKYGVSNKDIEKETAKDGASEPPSMTQLLRR

SEQ ID NO: 42318 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKYGVSNKDIEKETAKDGAAEPPSMTQLLRR

SEQ ID NO: 42319 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKYGVSNKDIEKETAKDSGGEPPSMTQLLRR

SEQ ID NO: 42320 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKYGVSNKDIEKETAKDSGSEPPSMTQLLRR

SEQ ID NO: 42321 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKYGVSNKDIEKETAKDSGAEPPSMTQLLRR

SEQ ID NO: 42322 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKYGVSNKDIEKETAKDSSGEPPSMTQLLRR

SEQ ID NO: 42323 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKYGVSNKDIEKETAKDSSSEPPSMTQLLRR

SEQ ID NO: 42324 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKYGVSNKDIEKETAKDSSAEPPSMTQLLRR

SEQ ID NO: 42325 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKYGVSNKDIEKETAKDSAGEPPSMTQLLRR

SEQ ID NO: 42326 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKYGVSNKDIEKETAKDSASEPPSMTQLLRR

SEQ ID NO: 42327 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKYGVSNKDIEKETAKDSAAEPPSMTQLLRR

SEQ ID NO: 42328 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKYGVSNKDIEKETAKDAGGEPPSMTQLLRR

SEQ ID NO: 42329 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKYGVSNKDIEKETAKDAGSEPPSMTQLLRR

SEQ ID NO: 42330 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKYGVSNKDIEKETAKDAGAEPPSMTQLLRR

SEQ ID NO: 42331 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKYGVSNKDIEKETAKDASGEPPSMTQLLRR

SEQ ID NO: 42332 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKYGVSNKDIEKETAKDASSEPPSMTQLLRR

SEQ ID NO: 42333 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKYGVSNKDIEKETAKDASAEPPSMTQLLRR

SEQ ID NO: 42334 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKYGVSNKDIEKETAKDAAGEPPSMTQLLRR

SEQ ID NO: 42335 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKYGVSNKDIEKETAKDAASEPPSMTQLLRR

SEQ ID NO: 42336 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKYGVSNKDIEKETAKDAAAEPPSMTQLLRR

SEQ ID NO: 42337 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKKGVSNKDIEKETAKDGGGEPPSMTQLLRR

SEQ ID NO: 42338 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKKGVSNKDIEKETAKDGGSEPPSMTQLLRR

SEQ ID NO: 42339 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKKGVSNKDIEKETAKDGGAEPPSMTQLLRR

SEQ ID NO: 42340 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKKGVSNKDIEKETAKDGSGEPPSMTQLLRR

SEQ ID NO: 42341 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKKGVSNKDIEKETAKDGSSEPPSMTQLLRR

SEQ ID NO: 42342 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKKGVSNKDIEKETAKDGSAEPPSMTQLLRR

SEQ ID NO: 42343 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKKGVSNKDIEKETAKDGAGEPPSMTQLLRR

SEQ ID NO: 42344 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKKGVSNKDIEKETAKDGASEPPSMTQLLRR

SEQ ID NO: 42345 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKKGVSNKDIEKETAKDGAAEPPSMTQLLRR

SEQ ID NO: 42346 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKKGVSNKDIEKETAKDSGGEPPSMTQLLRR

SEQ ID NO: 42347 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKKGVSNKDIEKETAKDSGSEPPSMTQLLRR

SEQ ID NO: 42348 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKKGVSNKDIEKETAKDSGAEPPSMTQLLRR

SEQ ID NO: 42349 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKKGVSNKDIEKETAKDSSGEPPSMTQLLRR

SEQ ID NO: 42350 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKKGVSNKDIEKETAKDSSSEPPSMTQLLRR

SEQ ID NO: 42351 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKKGVSNKDIEKETAKDSSAEPPSMTQLLRR

SEQ ID NO: 42352 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKKGVSNKDIEKETAKDSAGEPPSMTQLLRR

SEQ ID NO: 42353 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKKGVSNKDIEKETAKDSASEPPSMTQLLRR

SEQ ID NO: 42354 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKKGVSNKDIEKETAKDSAAEPPSMTQLLRR

SEQ ID NO: 42355 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKKGVSNKDIEKETAKDAGGEPPSMTQLLRR

SEQ ID NO: 42356 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKKGVSNKDIEKETAKDAGSEPPSMTQLLRR

SEQ ID NO: 42357 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKKGVSNKDIEKETAKDAGAEPPSMTQLLRR

SEQ ID NO: 42358 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKKGVSNKDIEKETAKDASGEPPSMTQLLRR

SEQ ID NO: 42359 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKKGVSNKDIEKETAKDASSEPPSMTQLLRR

SEQ ID NO: 42360 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKKGVSNKDIEKETAKDASAEPPSMTQLLRR

SEQ ID NO: 42361 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKKGVSNKDIEKETAKDAAGEPPSMTQLLRR

SEQ ID NO: 42362 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKKGVSNKDIEKETAKDAASEPPSMTQLLRR

SEQ ID NO: 42363 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKKGVSNKDIEKETAKDAAAEPPSMTQLLRR

SEQ ID NO: 42364 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKNGVSNKDIEKETAKDGGGEPPSMTQLLRR

SEQ ID NO: 42365 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKNGVSNKDIEKETAKDGGSEPPSMTQLLRR

SEQ ID NO: 42366 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKNGVSNKDIEKETAKDGGAEPPSMTQLLRR

SEQ ID NO: 42367 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKNGVSNKDIEKETAKDGSGEPPSMTQLLRR

SEQ ID NO: 42368 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKNGVSNKDIEKETAKDGSSEPPSMTQLLRR

SEQ ID NO: 42369 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKNGVSNKDIEKETAKDGSAEPPSMTQLLRR

SEQ ID NO: 42370 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKNGVSNKDIEKETAKDGAGEPPSMTQLLRR

SEQ ID NO: 42371 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKNGVSNKDIEKETAKDGASEPPSMTQLLRR

SEQ ID NO: 42372 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKNGVSNKDIEKETAKDGAAEPPSMTQLLRR

SEQ ID NO: 42373 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKNGVSNKDIEKETAKDSGGEPPSMTQLLRR

SEQ ID NO: 42374 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKNGVSNKDIEKETAKDSGSEPPSMTQLLRR

SEQ ID NO: 42375 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKNGVSNKDIEKETAKDSGAEPPSMTQLLRR

SEQ ID NO: 42376 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKNGVSNKDIEKETAKDSSGEPPSMTQLLRR

SEQ ID NO: 42377 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKNGVSNKDIEKETAKDSSSEPPSMTQLLRR

SEQ ID NO: 42378 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKNGVSNKDIEKETAKDSSAEPPSMTQLLRR

SEQ ID NO: 42379 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKNGVSNKDIEKETAKDSAGEPPSMTQLLRR

SEQ ID NO: 42380 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKNGVSNKDIEKETAKDSASEPPSMTQLLRR

SEQ ID NO: 42381 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKNGVSNKDIEKETAKDSAAEPPSMTQLLRR

SEQ ID NO: 42382 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKNGVSNKDIEKETAKDAGGEPPSMTQLLRR

SEQ ID NO: 42383 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKNGVSNKDIEKETAKDAGSEPPSMTQLLRR

SEQ ID NO: 42384 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKNGVSNKDIEKETAKDAGAEPPSMTQLLRR

SEQ ID NO: 42385 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKNGVSNKDIEKETAKDASGEPPSMTQLLRR

SEQ ID NO: 42386 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKNGVSNKDIEKETAKDASSEPPSMTQLLRR

SEQ ID NO: 42387 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKNGVSNKDIEKETAKDASAEPPSMTQLLRR

SEQ ID NO: 42388 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKNGVSNKDIEKETAKDAAGEPPSMTQLLRR

SEQ ID NO: 42389 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKNGVSNKDIEKETAKDAASEPPSMTQLLRR

SEQ ID NO: 42390 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKNGVSNKDIEKETAKDAAAEPPSMTQLLRR

SEQ ID NO: 42391 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKMGVSNKDIEKETAKDGGGEPPSMTQLLRR

SEQ ID NO: 42392 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKMGVSNKDIEKETAKDGGSEPPSMTQLLRR

SEQ ID NO: 42393 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKMGVSNKDIEKETAKDGGAEPPSMTQLLRR

SEQ ID NO: 42394 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKMGVSNKDIEKETAKDGSGEPPSMTQLLRR

SEQ ID NO: 42395 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKMGVSNKDIEKETAKDGSSEPPSMTQLLRR

SEQ ID NO: 42396 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKMGVSNKDIEKETAKDGSAEPPSMTQLLRR

SEQ ID NO: 42397 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKMGVSNKDIEKETAKDGAGEPPSMTQLLRR

SEQ ID NO: 42398 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKMGVSNKDIEKETAKDGASEPPSMTQLLRR

SEQ ID NO: 42399 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKMGVSNKDIEKETAKDGAAEPPSMTQLLRR

SEQ ID NO: 42400 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKMGVSNKDIEKETAKDSGGEPPSMTQLLRR

SEQ ID NO: 42401 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKMGVSNKDIEKETAKDSGSEPPSMTQLLRR

SEQ ID NO: 42402 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKMGVSNKDIEKETAKDSGAEPPSMTQLLRR

SEQ ID NO: 42403 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKMGVSNKDIEKETAKDSSGEPPSMTQLLRR

SEQ ID NO: 42404 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKMGVSNKDIEKETAKDSSSEPPSMTQLLRR

SEQ ID NO: 42405 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKMGVSNKDIEKETAKDSSAEPPSMTQLLRR

SEQ ID NO: 42406 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKMGVSNKDIEKETAKDSAGEPPSMTQLLRR

SEQ ID NO: 42407 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKMGVSNKDIEKETAKDSASEPPSMTQLLRR

SEQ ID NO: 42408 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKMGVSNKDIEKETAKDSAAEPPSMTQLLRR

SEQ ID NO: 42409 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKMGVSNKDIEKETAKDAGGEPPSMTQLLRR

SEQ ID NO: 42410 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKMGVSNKDIEKETAKDAGSEPPSMTQLLRR

SEQ ID NO: 42411 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKMGVSNKDIEKETAKDAGAEPPSMTQLLRR

SEQ ID NO: 42412 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKMGVSNKDIEKETAKDASGEPPSMTQLLRR

SEQ ID NO: 42413 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKMGVSNKDIEKETAKDASSEPPSMTQLLRR

SEQ ID NO: 42414 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKMGVSNKDIEKETAKDASAEPPSMTQLLRR

SEQ ID NO: 42415 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKMGVSNKDIEKETAKDAAGEPPSMTQLLRR

SEQ ID NO: 42416 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKMGVSNKDIEKETAKDAASEPPSMTQLLRR

SEQ ID NO: 42417 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKMGVSNKDIEKETAKDAAAEPPSMTQLLRR

SEQ ID NO: 42418 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKCGVSNKDIEKETAKDGGGEPPSMTQLLRR

SEQ ID NO: 42419 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKCGVSNKDIEKETAKDGGSEPPSMTQLLRR

SEQ ID NO: 42420 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKCGVSNKDIEKETAKDGGAEPPSMTQLLRR

SEQ ID NO: 42421 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKCGVSNKDIEKETAKDGSGEPPSMTQLLRR

SEQ ID NO: 42422 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKCGVSNKDIEKETAKDGSSEPPSMTQLLRR

SEQ ID NO: 42423 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKCGVSNKDIEKETAKDGSAEPPSMTQLLRR

SEQ ID NO: 42424 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKCGVSNKDIEKETAKDGAGEPPSMTQLLRR

SEQ ID NO: 42425 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKCGVSNKDIEKETAKDGASEPPSMTQLLRR

SEQ ID NO: 42426 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKCGVSNKDIEKETAKDGAAEPPSMTQLLRR

SEQ ID NO: 42427 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKCGVSNKDIEKETAKDSGGEPPSMTQLLRR

SEQ ID NO: 42428 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKCGVSNKDIEKETAKDSGSEPPSMTQLLRR

SEQ ID NO: 42429 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKCGVSNKDIEKETAKDSGAEPPSMTQLLRR

SEQ ID NO: 42430 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKCGVSNKDIEKETAKDSSGEPPSMTQLLRR

SEQ ID NO: 42431 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKCGVSNKDIEKETAKDSSSEPPSMTQLLRR

SEQ ID NO: 42432 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKCGVSNKDIEKETAKDSSAEPPSMTQLLRR

SEQ ID NO: 42433 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKCGVSNKDIEKETAKDSAGEPPSMTQLLRR

SEQ ID NO: 42434 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKCGVSNKDIEKETAKDSASEPPSMTQLLRR

SEQ ID NO: 42435 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKCGVSNKDIEKETAKDSAAEPPSMTQLLRR

SEQ ID NO: 42436 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKCGVSNKDIEKETAKDAGGEPPSMTQLLRR

SEQ ID NO: 42437 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKCGVSNKDIEKETAKDAGSEPPSMTQLLRR

SEQ ID NO: 42438 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKCGVSNKDIEKETAKDAGAEPPSMTQLLRR

SEQ ID NO: 42439 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKCGVSNKDIEKETAKDASGEPPSMTQLLRR

SEQ ID NO: 42440 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKCGVSNKDIEKETAKDASSEPPSMTQLLRR

SEQ ID NO: 42441 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKCGVSNKDIEKETAKDASAEPPSMTQLLRR

SEQ ID NO: 42442 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKCGVSNKDIEKETAKDAAGEPPSMTQLLRR

SEQ ID NO: 42443 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKCGVSNKDIEKETAKDAASEPPSMTQLLRR

SEQ ID NO: 42444 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKCGVSNKDIEKETAKDAAAEPPSMTQLLRR

SEQ ID NO: 42445 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKSGVSNKDIEKETAKDGGGEPPSMTQLLRR

SEQ ID NO: 42446 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKSGVSNKDIEKETAKDGGSEPPSMTQLLRR

SEQ ID NO: 42447 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKSGVSNKDIEKETAKDGGAEPPSMTQLLRR

SEQ ID NO: 42448 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKSGVSNKDIEKETAKDGSGEPPSMTQLLRR

SEQ ID NO: 42449 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKSGVSNKDIEKETAKDGSSEPPSMTQLLRR

SEQ ID NO: 42450 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKSGVSNKDIEKETAKDGSAEPPSMTQLLRR

SEQ ID NO: 42451 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKSGVSNKDIEKETAKDGAGEPPSMTQLLRR

SEQ ID NO: 42452 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKSGVSNKDIEKETAKDGASEPPSMTQLLRR

SEQ ID NO: 42453 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKSGVSNKDIEKETAKDGAAEPPSMTQLLRR

SEQ ID NO: 42454 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKSGVSNKDIEKETAKDSGGEPPSMTQLLRR

SEQ ID NO: 42455 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKSGVSNKDIEKETAKDSGSEPPSMTQLLRR

SEQ ID NO: 42456 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKSGVSNKDIEKETAKDSGAEPPSMTQLLRR

SEQ ID NO: 42457 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKSGVSNKDIEKETAKDSSGEPPSMTQLLRR

SEQ ID NO: 42458 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKSGVSNKDIEKETAKDSSSEPPSMTQLLRR

SEQ ID NO: 42459 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKSGVSNKDIEKETAKDSSAEPPSMTQLLRR

SEQ ID NO: 42460 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKSGVSNKDIEKETAKDSAGEPPSMTQLLRR

SEQ ID NO: 42461 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKSGVSNKDIEKETAKDSASEPPSMTQLLRR

SEQ ID NO: 42462 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKSGVSNKDIEKETAKDSAAEPPSMTQLLRR

SEQ ID NO: 42463 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKSGVSNKDIEKETAKDAGGEPPSMTQLLRR

SEQ ID NO: 42464 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKSGVSNKDIEKETAKDAGSEPPSMTQLLRR

SEQ ID NO: 42465 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKSGVSNKDIEKETAKDAGAEPPSMTQLLRR

SEQ ID NO: 42466 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKSGVSNKDIEKETAKDASGEPPSMTQLLRR

SEQ ID NO: 42467 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKSGVSNKDIEKETAKDASSEPPSMTQLLRR

SEQ ID NO: 42468 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKSGVSNKDIEKETAKDASAEPPSMTQLLRR

SEQ ID NO: 42469 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKSGVSNKDIEKETAKDAAGEPPSMTQLLRR

SEQ ID NO: 42470 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKSGVSNKDIEKETAKDAASEPPSMTQLLRR

SEQ ID NO: 42471 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKSGVSNKDIEKETAKDAAAEPPSMTQLLRR

SEQ ID NO: 42472 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKAGVSNKDIEKETAKDGGGEPPSMTQLLRR

SEQ ID NO: 42473 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKAGVSNKDIEKETAKDGGSEPPSMTQLLRR

SEQ ID NO: 42474 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKAGVSNKDIEKETAKDGGAEPPSMTQLLRR

SEQ ID NO: 42475 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKAGVSNKDIEKETAKDGSGEPPSMTQLLRR

SEQ ID NO: 42476 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKAGVSNKDIEKETAKDGSSEPPSMTQLLRR

SEQ ID NO: 42477 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKAGVSNKDIEKETAKDGSAEPPSMTQLLRR

SEQ ID NO: 42478 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKAGVSNKDIEKETAKDGAGEPPSMTQLLRR

SEQ ID NO: 42479 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKAGVSNKDIEKETAKDGASEPPSMTQLLRR

SEQ ID NO: 42480 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKAGVSNKDIEKETAKDGAAEPPSMTQLLRR

SEQ ID NO: 42481 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKAGVSNKDIEKETAKDSGGEPPSMTQLLRR

SEQ ID NO: 42482 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKAGVSNKDIEKETAKDSGSEPPSMTQLLRR

SEQ ID NO: 42483 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKAGVSNKDIEKETAKDSGAEPPSMTQLLRR

SEQ ID NO: 42484 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKAGVSNKDIEKETAKDSSGEPPSMTQLLRR

SEQ ID NO: 42485 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKAGVSNKDIEKETAKDSSSEPPSMTQLLRR

SEQ ID NO: 42486 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKAGVSNKDIEKETAKDSSAEPPSMTQLLRR

SEQ ID NO: 42487 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKAGVSNKDIEKETAKDSAGEPPSMTQLLRR

SEQ ID NO: 42488 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKAGVSNKDIEKETAKDSASEPPSMTQLLRR

SEQ ID NO: 42489 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKAGVSNKDIEKETAKDSAAEPPSMTQLLRR

SEQ ID NO: 42490 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKAGVSNKDIEKETAKDAGGEPPSMTQLLRR

SEQ ID NO: 42491 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKAGVSNKDIEKETAKDAGSEPPSMTQLLRR

SEQ ID NO: 42492 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKAGVSNKDIEKETAKDAGAEPPSMTQLLRR

SEQ ID NO: 42493 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKAGVSNKDIEKETAKDASGEPPSMTQLLRR

SEQ ID NO: 42494 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKAGVSNKDIEKETAKDASSEPPSMTQLLRR

SEQ ID NO: 42495 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKAGVSNKDIEKETAKDASAEPPSMTQLLRR

SEQ ID NO: 42496 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKAGVSNKDIEKETAKDAAGEPPSMTQLLRR

SEQ ID NO: 42497 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKAGVSNKDIEKETAKDAASEPPSMTQLLRR

SEQ ID NO: 42498 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKAGVSNKDIEKETAKDAAAEPPSMTQLLRR

SEQ ID NO: 42499 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKGGVSNKDIEKETAKDGGGEPPSMTQLLRR

SEQ ID NO: 42500 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKGGVSNKDIEKETAKDGGSEPPSMTQLLRR

SEQ ID NO: 42501 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKGGVSNKDIEKETAKDGGAEPPSMTQLLRR

SEQ ID NO: 42502 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKGGVSNKDIEKETAKDGSGEPPSMTQLLRR

SEQ ID NO: 42503 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKGGVSNKDIEKETAKDGSSEPPSMTQLLRR

SEQ ID NO: 42504 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKGGVSNKDIEKETAKDGSAEPPSMTQLLRR

SEQ ID NO: 42505 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKGGVSNKDIEKETAKDGAGEPPSMTQLLRR

SEQ ID NO: 42506 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKGGVSNKDIEKETAKDGASEPPSMTQLLRR

SEQ ID NO: 42507 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKGGVSNKDIEKETAKDGAAEPPSMTQLLRR

SEQ ID NO: 42508 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKGGVSNKDIEKETAKDSGGEPPSMTQLLRR

SEQ ID NO: 42509 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKGGVSNKDIEKETAKDSGSEPPSMTQLLRR

SEQ ID NO: 42510 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKGGVSNKDIEKETAKDSGAEPPSMTQLLRR

SEQ ID NO: 42511 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKGGVSNKDIEKETAKDSSGEPPSMTQLLRR

SEQ ID NO: 42512 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKGGVSNKDIEKETAKDSSSEPPSMTQLLRR

SEQ ID NO: 42513 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKGGVSNKDIEKETAKDSSAEPPSMTQLLRR

SEQ ID NO: 42514 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKGGVSNKDIEKETAKDSAGEPPSMTQLLRR

SEQ ID NO: 42515 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKGGVSNKDIEKETAKDSASEPPSMTQLLRR

SEQ ID NO: 42516 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKGGVSNKDIEKETAKDSAAEPPSMTQLLRR

SEQ ID NO: 42517 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKGGVSNKDIEKETAKDAGGEPPSMTQLLRR

SEQ ID NO: 42518 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKGGVSNKDIEKETAKDAGSEPPSMTQLLRR

SEQ ID NO: 42519 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKGGVSNKDIEKETAKDAGAEPPSMTQLLRR

SEQ ID NO: 42520 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKGGVSNKDIEKETAKDASGEPPSMTQLLRR

SEQ ID NO: 42521 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKGGVSNKDIEKETAKDASSEPPSMTQLLRR

SEQ ID NO: 42522 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKGGVSNKDIEKETAKDASAEPPSMTQLLRR

SEQ ID NO: 42523 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKGGVSNKDIEKETAKDAAGEPPSMTQLLRR

SEQ ID NO: 42524 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKGGVSNKDIEKETAKDAASEPPSMTQLLRR

SEQ ID NO: 42525 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKGGVSNKDIEKETAKDAAAEPPSMTQLLRR

SEQ ID NO: 42526 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKDGVSNKDIEKETAKDGGGEPPSMTQLLRR

SEQ ID NO: 42527 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKDGVSNKDIEKETAKDGGSEPPSMTQLLRR

SEQ ID NO: 42528 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKDGVSNKDIEKETAKDGGAEPPSMTQLLRR

SEQ ID NO: 42529 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKDGVSNKDIEKETAKDGSGEPPSMTQLLRR

SEQ ID NO: 42530 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKDGVSNKDIEKETAKDGSSEPPSMTQLLRR

SEQ ID NO: 42531 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKDGVSNKDIEKETAKDGSAEPPSMTQLLRR

SEQ ID NO: 42532 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKDGVSNKDIEKETAKDGAGEPPSMTQLLRR

SEQ ID NO: 42533 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKDGVSNKDIEKETAKDGASEPPSMTQLLRR

SEQ ID NO: 42534 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKDGVSNKDIEKETAKDGAAEPPSMTQLLRR

SEQ ID NO: 42535 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKDGVSNKDIEKETAKDSGGEPPSMTQLLRR

SEQ ID NO: 42536 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKDGVSNKDIEKETAKDSGSEPPSMTQLLRR

SEQ ID NO: 42537 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKDGVSNKDIEKETAKDSGAEPPSMTQLLRR

SEQ ID NO: 42538 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKDGVSNKDIEKETAKDSSGEPPSMTQLLRR

SEQ ID NO: 42539 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKDGVSNKDIEKETAKDSSSEPPSMTQLLRR

SEQ ID NO: 42540 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKDGVSNKDIEKETAKDSSAEPPSMTQLLRR

SEQ ID NO: 42541 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKDGVSNKDIEKETAKDSAGEPPSMTQLLRR

SEQ ID NO: 42542 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKDGVSNKDIEKETAKDSASEPPSMTQLLRR

SEQ ID NO: 42543 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKDGVSNKDIEKETAKDSAAEPPSMTQLLRR

SEQ ID NO: 42544 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKDGVSNKDIEKETAKDAGGEPPSMTQLLRR

SEQ ID NO: 42545 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKDGVSNKDIEKETAKDAGSEPPSMTQLLRR

SEQ ID NO: 42546 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKDGVSNKDIEKETAKDAGAEPPSMTQLLRR

SEQ ID NO: 42547 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKDGVSNKDIEKETAKDASGEPPSMTQLLRR

SEQ ID NO: 42548 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKDGVSNKDIEKETAKDASSEPPSMTQLLRR

SEQ ID NO: 42549 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKDGVSNKDIEKETAKDASAEPPSMTQLLRR

SEQ ID NO: 42550 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKDGVSNKDIEKETAKDAAGEPPSMTQLLRR

SEQ ID NO: 42551 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKDGVSNKDIEKETAKDAASEPPSMTQLLRR

SEQ ID NO: 42552 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKDGVSNKDIEKETAKDAAAEPPSMTQLLRR

SEQ ID NO: 42553 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKHGVSNKDIEKETAKDGGGEPPSMTQLLRR

SEQ ID NO: 42554 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKHGVSNKDIEKETAKDGGSEPPSMTQLLRR

SEQ ID NO: 42555 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKHGVSNKDIEKETAKDGGAEPPSMTQLLRR

SEQ ID NO: 42556 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKHGVSNKDIEKETAKDGSGEPPSMTQLLRR

SEQ ID NO: 42557 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKHGVSNKDIEKETAKDGSSEPPSMTQLLRR

SEQ ID NO: 42558 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKHGVSNKDIEKETAKDGSAEPPSMTQLLRR

SEQ ID NO: 42559 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKHGVSNKDIEKETAKDGAGEPPSMTQLLRR

SEQ ID NO: 42560 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKHGVSNKDIEKETAKDGASEPPSMTQLLRR

SEQ ID NO: 42561 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKHGVSNKDIEKETAKDGAAEPPSMTQLLRR

SEQ ID NO: 42562 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKHGVSNKDIEKETAKDSGGEPPSMTQLLRR

SEQ ID NO: 42563 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKHGVSNKDIEKETAKDSGSEPPSMTQLLRR

SEQ ID NO: 42564 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKHGVSNKDIEKETAKDSGAEPPSMTQLLRR

SEQ ID NO: 42565 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKHGVSNKDIEKETAKDSSGEPPSMTQLLRR

SEQ ID NO: 42566 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKHGVSNKDIEKETAKDSSSEPPSMTQLLRR

SEQ ID NO: 42567 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKHGVSNKDIEKETAKDSSAEPPSMTQLLRR

SEQ ID NO: 42568 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKHGVSNKDIEKETAKDSAGEPPSMTQLLRR

SEQ ID NO: 42569 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKHGVSNKDIEKETAKDSASEPPSMTQLLRR

SEQ ID NO: 42570 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKHGVSNKDIEKETAKDSAAEPPSMTQLLRR

SEQ ID NO: 42571 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKHGVSNKDIEKETAKDAGGEPPSMTQLLRR

SEQ ID NO: 42572 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKHGVSNKDIEKETAKDAGSEPPSMTQLLRR

SEQ ID NO: 42573 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKHGVSNKDIEKETAKDAGAEPPSMTQLLRR

SEQ ID NO: 42574 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKHGVSNKDIEKETAKDASGEPPSMTQLLRR

SEQ ID NO: 42575 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKHGVSNKDIEKETAKDASSEPPSMTQLLRR

SEQ ID NO: 42576 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKHGVSNKDIEKETAKDASAEPPSMTQLLRR

SEQ ID NO: 42577 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKHGVSNKDIEKETAKDAAGEPPSMTQLLRR

SEQ ID NO: 42578 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKHGVSNKDIEKETAKDAASEPPSMTQLLRR

SEQ ID NO: 42579 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKHGVSNKDIEKETAKDAAAEPPSMTQLLRR

SEQ ID NO: 42580 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKYGVSNKDIEKETAKDGGGEPPSMTQLLRR

SEQ ID NO: 42581 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKYGVSNKDIEKETAKDGGSEPPSMTQLLRR

SEQ ID NO: 42582 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKYGVSNKDIEKETAKDGGAEPPSMTQLLRR

SEQ ID NO: 42583 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKYGVSNKDIEKETAKDGSGEPPSMTQLLRR

SEQ ID NO: 42584 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKYGVSNKDIEKETAKDGSSEPPSMTQLLRR

SEQ ID NO: 42585 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKYGVSNKDIEKETAKDGSAEPPSMTQLLRR

SEQ ID NO: 42586 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKYGVSNKDIEKETAKDGAGEPPSMTQLLRR

SEQ ID NO: 42587 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKYGVSNKDIEKETAKDGASEPPSMTQLLRR

SEQ ID NO: 42588 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKYGVSNKDIEKETAKDGAAEPPSMTQLLRR

SEQ ID NO: 42589 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKYGVSNKDIEKETAKDSGGEPPSMTQLLRR

SEQ ID NO: 42590 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKYGVSNKDIEKETAKDSGSEPPSMTQLLRR

SEQ ID NO: 42591 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKYGVSNKDIEKETAKDSGAEPPSMTQLLRR

SEQ ID NO: 42592 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKYGVSNKDIEKETAKDSSGEPPSMTQLLRR

SEQ ID NO: 42593 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKYGVSNKDIEKETAKDSSSEPPSMTQLLRR

SEQ ID NO: 42594 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKYGVSNKDIEKETAKDSSAEPPSMTQLLRR

SEQ ID NO: 42595 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKYGVSNKDIEKETAKDSAGEPPSMTQLLRR

SEQ ID NO: 42596 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKYGVSNKDIEKETAKDSASEPPSMTQLLRR

SEQ ID NO: 42597 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKYGVSNKDIEKETAKDSAAEPPSMTQLLRR

SEQ ID NO: 42598 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKYGVSNKDIEKETAKDAGGEPPSMTQLLRR

SEQ ID NO: 42599 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKYGVSNKDIEKETAKDAGSEPPSMTQLLRR

SEQ ID NO: 42600 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKYGVSNKDIEKETAKDAGAEPPSMTQLLRR

SEQ ID NO: 42601 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKYGVSNKDIEKETAKDASGEPPSMTQLLRR

SEQ ID NO: 42602 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKYGVSNKDIEKETAKDASSEPPSMTQLLRR

SEQ ID NO: 42603 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKYGVSNKDIEKETAKDASAEPPSMTQLLRR

SEQ ID NO: 42604 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKYGVSNKDIEKETAKDAAGEPPSMTQLLRR

SEQ ID NO: 42605 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKYGVSNKDIEKETAKDAASEPPSMTQLLRR

SEQ ID NO: 42606 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKYGVSNKDIEKETAKDAAAEPPSMTQLLRR

SEQ ID NO: 42607 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKKGVSNKDIEKETAKDGGGEPPSMTQLLRR

SEQ ID NO: 42608 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKKGVSNKDIEKETAKDGGSEPPSMTQLLRR

SEQ ID NO: 42609 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKKGVSNKDIEKETAKDGGAEPPSMTQLLRR

SEQ ID NO: 42610 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKKGVSNKDIEKETAKDGSGEPPSMTQLLRR

SEQ ID NO: 42611 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKKGVSNKDIEKETAKDGSSEPPSMTQLLRR

SEQ ID NO: 42612 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKKGVSNKDIEKETAKDGSAEPPSMTQLLRR

SEQ ID NO: 42613 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKKGVSNKDIEKETAKDGAGEPPSMTQLLRR

SEQ ID NO: 42614 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKKGVSNKDIEKETAKDGASEPPSMTQLLRR

SEQ ID NO: 42615 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKKGVSNKDIEKETAKDGAAEPPSMTQLLRR

SEQ ID NO: 42616 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKKGVSNKDIEKETAKDSGGEPPSMTQLLRR

SEQ ID NO: 42617 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKKGVSNKDIEKETAKDSGSEPPSMTQLLRR

SEQ ID NO: 42618 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKKGVSNKDIEKETAKDSGAEPPSMTQLLRR

SEQ ID NO: 42619 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKKGVSNKDIEKETAKDSSGEPPSMTQLLRR

SEQ ID NO: 42620 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKKGVSNKDIEKETAKDSSSEPPSMTQLLRR

SEQ ID NO: 42621 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKKGVSNKDIEKETAKDSSAEPPSMTQLLRR

SEQ ID NO: 42622 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKKGVSNKDIEKETAKDSAGEPPSMTQLLRR

SEQ ID NO: 42623 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKKGVSNKDIEKETAKDSASEPPSMTQLLRR

SEQ ID NO: 42624 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKKGVSNKDIEKETAKDSAAEPPSMTQLLRR

SEQ ID NO: 42625 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKKGVSNKDIEKETAKDAGGEPPSMTQLLRR

SEQ ID NO: 42626 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKKGVSNKDIEKETAKDAGSEPPSMTQLLRR

SEQ ID NO: 42627 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKKGVSNKDIEKETAKDAGAEPPSMTQLLRR

SEQ ID NO: 42628 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKKGVSNKDIEKETAKDASGEPPSMTQLLRR

SEQ ID NO: 42629 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKKGVSNKDIEKETAKDASSEPPSMTQLLRR

SEQ ID NO: 42630 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKKGVSNKDIEKETAKDASAEPPSMTQLLRR

SEQ ID NO: 42631 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKKGVSNKDIEKETAKDAAGEPPSMTQLLRR

SEQ ID NO: 42632 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKKGVSNKDIEKETAKDAASEPPSMTQLLRR

SEQ ID NO: 42633 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKKGVSNKDIEKETAKDAAAEPPSMTQLLRR

SEQ ID NO: 42634 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKNGVSNKDIEKETAKDGGGEPPSMTQLLRR

SEQ ID NO: 42635 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKNGVSNKDIEKETAKDGGSEPPSMTQLLRR

SEQ ID NO: 42636 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKNGVSNKDIEKETAKDGGAEPPSMTQLLRR

SEQ ID NO: 42637 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKNGVSNKDIEKETAKDGSGEPPSMTQLLRR

SEQ ID NO: 42638 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKNGVSNKDIEKETAKDGSSEPPSMTQLLRR

SEQ ID NO: 42639 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKNGVSNKDIEKETAKDGSAEPPSMTQLLRR

SEQ ID NO: 42640 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKNGVSNKDIEKETAKDGAGEPPSMTQLLRR

SEQ ID NO: 42641 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKNGVSNKDIEKETAKDGASEPPSMTQLLRR

SEQ ID NO: 42642 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKNGVSNKDIEKETAKDGAAEPPSMTQLLRR

SEQ ID NO: 42643 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKNGVSNKDIEKETAKDSGGEPPSMTQLLRR

SEQ ID NO: 42644 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKNGVSNKDIEKETAKDSGSEPPSMTQLLRR

SEQ ID NO: 42645 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKNGVSNKDIEKETAKDSGAEPPSMTQLLRR

SEQ ID NO: 42646 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKNGVSNKDIEKETAKDSSGEPPSMTQLLRR

SEQ ID NO: 42647 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKNGVSNKDIEKETAKDSSSEPPSMTQLLRR

SEQ ID NO: 42648 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKNGVSNKDIEKETAKDSSAEPPSMTQLLRR

SEQ ID NO: 42649 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKNGVSNKDIEKETAKDSAGEPPSMTQLLRR

SEQ ID NO: 42650 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKNGVSNKDIEKETAKDSASEPPSMTQLLRR

SEQ ID NO: 42651 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKNGVSNKDIEKETAKDSAAEPPSMTQLLRR

SEQ ID NO: 42652 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKNGVSNKDIEKETAKDAGGEPPSMTQLLRR

SEQ ID NO: 42653 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKNGVSNKDIEKETAKDAGSEPPSMTQLLRR

SEQ ID NO: 42654 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKNGVSNKDIEKETAKDAGAEPPSMTQLLRR

SEQ ID NO: 42655 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKNGVSNKDIEKETAKDASGEPPSMTQLLRR

SEQ ID NO: 42656 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKNGVSNKDIEKETAKDASSEPPSMTQLLRR

SEQ ID NO: 42657 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKNGVSNKDIEKETAKDASAEPPSMTQLLRR

SEQ ID NO: 42658 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKNGVSNKDIEKETAKDAAGEPPSMTQLLRR

SEQ ID NO: 42659 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKNGVSNKDIEKETAKDAASEPPSMTQLLRR

SEQ ID NO: 42660 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKNGVSNKDIEKETAKDAAAEPPSMTQLLRR

SEQ ID NO: 42661 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKMGVSNKDIEKETAKDGGGEPPSMTQLLRR

SEQ ID NO: 42662 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKMGVSNKDIEKETAKDGGSEPPSMTQLLRR

SEQ ID NO: 42663 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKMGVSNKDIEKETAKDGGAEPPSMTQLLRR

SEQ ID NO: 42664 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKMGVSNKDIEKETAKDGSGEPPSMTQLLRR

SEQ ID NO: 42665 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKMGVSNKDIEKETAKDGSSEPPSMTQLLRR

SEQ ID NO: 42666 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKMGVSNKDIEKETAKDGSAEPPSMTQLLRR

SEQ ID NO: 42667 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKMGVSNKDIEKETAKDGAGEPPSMTQLLRR

SEQ ID NO: 42668 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKMGVSNKDIEKETAKDGASEPPSMTQLLRR

SEQ ID NO: 42669 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKMGVSNKDIEKETAKDGAAEPPSMTQLLRR

SEQ ID NO: 42670 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKMGVSNKDIEKETAKDSGGEPPSMTQLLRR

SEQ ID NO: 42671 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKMGVSNKDIEKETAKDSGSEPPSMTQLLRR

SEQ ID NO: 42672 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKMGVSNKDIEKETAKDSGAEPPSMTQLLRR

SEQ ID NO: 42673 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKMGVSNKDIEKETAKDSSGEPPSMTQLLRR

SEQ ID NO: 42674 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKMGVSNKDIEKETAKDSSSEPPSMTQLLRR

SEQ ID NO: 42675 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKMGVSNKDIEKETAKDSSAEPPSMTQLLRR

SEQ ID NO: 42676 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKMGVSNKDIEKETAKDSAGEPPSMTQLLRR

SEQ ID NO: 42677 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKMGVSNKDIEKETAKDSASEPPSMTQLLRR

SEQ ID NO: 42678 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKMGVSNKDIEKETAKDSAAEPPSMTQLLRR

SEQ ID NO: 42679 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKMGVSNKDIEKETAKDAGGEPPSMTQLLRR

SEQ ID NO: 42680 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKMGVSNKDIEKETAKDAGSEPPSMTQLLRR

SEQ ID NO: 42681 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKMGVSNKDIEKETAKDAGAEPPSMTQLLRR

SEQ ID NO: 42682 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKMGVSNKDIEKETAKDASGEPPSMTQLLRR

SEQ ID NO: 42683 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKMGVSNKDIEKETAKDASSEPPSMTQLLRR

SEQ ID NO: 42684 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKMGVSNKDIEKETAKDASAEPPSMTQLLRR

SEQ ID NO: 42685 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKMGVSNKDIEKETAKDAAGEPPSMTQLLRR

SEQ ID NO: 42686 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKMGVSNKDIEKETAKDAASEPPSMTQLLRR

SEQ ID NO: 42687 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKMGVSNKDIEKETAKDAAAEPPSMTQLLRR

SEQ ID NO: 42688 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKCGVSNKDIEKETAKDGGGEPPSMTQLLRR

SEQ ID NO: 42689 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKCGVSNKDIEKETAKDGGSEPPSMTQLLRR

SEQ ID NO: 42690 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKCGVSNKDIEKETAKDGGAEPPSMTQLLRR

SEQ ID NO: 42691 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKCGVSNKDIEKETAKDGSGEPPSMTQLLRR

SEQ ID NO: 42692 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKCGVSNKDIEKETAKDGSSEPPSMTQLLRR

SEQ ID NO: 42693 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKCGVSNKDIEKETAKDGSAEPPSMTQLLRR

SEQ ID NO: 42694 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKCGVSNKDIEKETAKDGAGEPPSMTQLLRR

SEQ ID NO: 42695 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKCGVSNKDIEKETAKDGASEPPSMTQLLRR

SEQ ID NO: 42696 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKCGVSNKDIEKETAKDGAAEPPSMTQLLRR

SEQ ID NO: 42697 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKCGVSNKDIEKETAKDSGGEPPSMTQLLRR

SEQ ID NO: 42698 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKCGVSNKDIEKETAKDSGSEPPSMTQLLRR

SEQ ID NO: 42699 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKCGVSNKDIEKETAKDSGAEPPSMTQLLRR

SEQ ID NO: 42700 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKCGVSNKDIEKETAKDSSGEPPSMTQLLRR

SEQ ID NO: 42701 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKCGVSNKDIEKETAKDSSSEPPSMTQLLRR

SEQ ID NO: 42702 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKCGVSNKDIEKETAKDSSAEPPSMTQLLRR

SEQ ID NO: 42703 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKCGVSNKDIEKETAKDSAGEPPSMTQLLRR

SEQ ID NO: 42704 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKCGVSNKDIEKETAKDSASEPPSMTQLLRR

SEQ ID NO: 42705 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKCGVSNKDIEKETAKDSAAEPPSMTQLLRR

SEQ ID NO: 42706 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKCGVSNKDIEKETAKDAGGEPPSMTQLLRR

SEQ ID NO: 42707 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKCGVSNKDIEKETAKDAGSEPPSMTQLLRR

SEQ ID NO: 42708 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKCGVSNKDIEKETAKDAGAEPPSMTQLLRR

SEQ ID NO: 42709 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKCGVSNKDIEKETAKDASGEPPSMTQLLRR

SEQ ID NO: 42710 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKCGVSNKDIEKETAKDASSEPPSMTQLLRR

SEQ ID NO: 42711 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKCGVSNKDIEKETAKDASAEPPSMTQLLRR

SEQ ID NO: 42712 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKCGVSNKDIEKETAKDAAGEPPSMTQLLRR

SEQ ID NO: 42713 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKCGVSNKDIEKETAKDAASEPPSMTQLLRR

SEQ ID NO: 42714 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKCGVSNKDIEKETAKDAAAEPPSMTQLLRR

SEQ ID NO: 42715 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKSGVSNKDIEKETAKDGGGEPPSMTQLLRR

SEQ ID NO: 42716 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKSGVSNKDIEKETAKDGGSEPPSMTQLLRR

SEQ ID NO: 42717 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKSGVSNKDIEKETAKDGGAEPPSMTQLLRR

SEQ ID NO: 42718 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKSGVSNKDIEKETAKDGSGEPPSMTQLLRR

SEQ ID NO: 42719 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKSGVSNKDIEKETAKDGSSEPPSMTQLLRR

SEQ ID NO: 42720 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKSGVSNKDIEKETAKDGSAEPPSMTQLLRR

SEQ ID NO: 42721 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKSGVSNKDIEKETAKDGAGEPPSMTQLLRR

SEQ ID NO: 42722 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKSGVSNKDIEKETAKDGASEPPSMTQLLRR

SEQ ID NO: 42723 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKSGVSNKDIEKETAKDGAAEPPSMTQLLRR

SEQ ID NO: 42724 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKSGVSNKDIEKETAKDSGGEPPSMTQLLRR

SEQ ID NO: 42725 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKSGVSNKDIEKETAKDSGSEPPSMTQLLRR

SEQ ID NO: 42726 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKSGVSNKDIEKETAKDSGAEPPSMTQLLRR

SEQ ID NO: 42727 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKSGVSNKDIEKETAKDSSGEPPSMTQLLRR

SEQ ID NO: 42728 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKSGVSNKDIEKETAKDSSSEPPSMTQLLRR

SEQ ID NO: 42729 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKSGVSNKDIEKETAKDSSAEPPSMTQLLRR

SEQ ID NO: 42730 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKSGVSNKDIEKETAKDSAGEPPSMTQLLRR

SEQ ID NO: 42731 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKSGVSNKDIEKETAKDSASEPPSMTQLLRR

SEQ ID NO: 42732 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKSGVSNKDIEKETAKDSAAEPPSMTQLLRR

SEQ ID NO: 42733 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKSGVSNKDIEKETAKDAGGEPPSMTQLLRR

SEQ ID NO: 42734 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKSGVSNKDIEKETAKDAGSEPPSMTQLLRR

SEQ ID NO: 42735 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKSGVSNKDIEKETAKDAGAEPPSMTQLLRR

SEQ ID NO: 42736 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKSGVSNKDIEKETAKDASGEPPSMTQLLRR

SEQ ID NO: 42737 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKSGVSNKDIEKETAKDASSEPPSMTQLLRR

SEQ ID NO: 42738 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKSGVSNKDIEKETAKDASAEPPSMTQLLRR

SEQ ID NO: 42739 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKSGVSNKDIEKETAKDAAGEPPSMTQLLRR

SEQ ID NO: 42740 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKSGVSNKDIEKETAKDAASEPPSMTQLLRR

SEQ ID NO: 42741 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKSGVSNKDIEKETAKDAAAEPPSMTQLLRR

SEQ ID NO: 42742 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKAGVSNKDIEKETAKDGGGEPPSMTQLLRR

SEQ ID NO: 42743 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKAGVSNKDIEKETAKDGGSEPPSMTQLLRR

SEQ ID NO: 42744 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKAGVSNKDIEKETAKDGGAEPPSMTQLLRR

SEQ ID NO: 42745 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKAGVSNKDIEKETAKDGSGEPPSMTQLLRR

SEQ ID NO: 42746 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKAGVSNKDIEKETAKDGSSEPPSMTQLLRR

SEQ ID NO: 42747 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKAGVSNKDIEKETAKDGSAEPPSMTQLLRR

SEQ ID NO: 42748 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKAGVSNKDIEKETAKDGAGEPPSMTQLLRR

SEQ ID NO: 42749 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKAGVSNKDIEKETAKDGASEPPSMTQLLRR

SEQ ID NO: 42750 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKAGVSNKDIEKETAKDGAAEPPSMTQLLRR

SEQ ID NO: 42751 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKAGVSNKDIEKETAKDSGGEPPSMTQLLRR

SEQ ID NO: 42752 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKAGVSNKDIEKETAKDSGSEPPSMTQLLRR

SEQ ID NO: 42753 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKAGVSNKDIEKETAKDSGAEPPSMTQLLRR

SEQ ID NO: 42754 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKAGVSNKDIEKETAKDSSGEPPSMTQLLRR

SEQ ID NO: 42755 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKAGVSNKDIEKETAKDSSSEPPSMTQLLRR

SEQ ID NO: 42756 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKAGVSNKDIEKETAKDSSAEPPSMTQLLRR

SEQ ID NO: 42757 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKAGVSNKDIEKETAKDSAGEPPSMTQLLRR

SEQ ID NO: 42758 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKAGVSNKDIEKETAKDSASEPPSMTQLLRR

SEQ ID NO: 42759 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKAGVSNKDIEKETAKDSAAEPPSMTQLLRR

SEQ ID NO: 42760 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKAGVSNKDIEKETAKDAGGEPPSMTQLLRR

SEQ ID NO: 42761 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKAGVSNKDIEKETAKDAGSEPPSMTQLLRR

SEQ ID NO: 42762 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKAGVSNKDIEKETAKDAGAEPPSMTQLLRR

SEQ ID NO: 42763 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKAGVSNKDIEKETAKDASGEPPSMTQLLRR

SEQ ID NO: 42764 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKAGVSNKDIEKETAKDASSEPPSMTQLLRR

SEQ ID NO: 42765 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKAGVSNKDIEKETAKDASAEPPSMTQLLRR

SEQ ID NO: 42766 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKAGVSNKDIEKETAKDAAGEPPSMTQLLRR

SEQ ID NO: 42767 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKAGVSNKDIEKETAKDAASEPPSMTQLLRR

SEQ ID NO: 42768 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKAGVSNKDIEKETAKDAAAEPPSMTQLLRR

SEQ ID NO: 42769 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKGGVSNKDIEKETAKDGGGEPPSMTQLLRR

SEQ ID NO: 42770 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKGGVSNKDIEKETAKDGGSEPPSMTQLLRR

SEQ ID NO: 42771 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKGGVSNKDIEKETAKDGGAEPPSMTQLLRR

SEQ ID NO: 42772 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKGGVSNKDIEKETAKDGSGEPPSMTQLLRR

SEQ ID NO: 42773 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKGGVSNKDIEKETAKDGSSEPPSMTQLLRR

SEQ ID NO: 42774 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKGGVSNKDIEKETAKDGSAEPPSMTQLLRR

SEQ ID NO: 42775 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKGGVSNKDIEKETAKDGAGEPPSMTQLLRR

SEQ ID NO: 42776 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKGGVSNKDIEKETAKDGASEPPSMTQLLRR

SEQ ID NO: 42777 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKGGVSNKDIEKETAKDGAAEPPSMTQLLRR

SEQ ID NO: 42778 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKGGVSNKDIEKETAKDSGGEPPSMTQLLRR

SEQ ID NO: 42779 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKGGVSNKDIEKETAKDSGSEPPSMTQLLRR

SEQ ID NO: 42780 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKGGVSNKDIEKETAKDSGAEPPSMTQLLRR

SEQ ID NO: 42781 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKGGVSNKDIEKETAKDSSGEPPSMTQLLRR

SEQ ID NO: 42782 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKGGVSNKDIEKETAKDSSSEPPSMTQLLRR

SEQ ID NO: 42783 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKGGVSNKDIEKETAKDSSAEPPSMTQLLRR

SEQ ID NO: 42784 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKGGVSNKDIEKETAKDSAGEPPSMTQLLRR

SEQ ID NO: 42785 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKGGVSNKDIEKETAKDSASEPPSMTQLLRR

SEQ ID NO: 42786 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKGGVSNKDIEKETAKDSAAEPPSMTQLLRR

SEQ ID NO: 42787 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKGGVSNKDIEKETAKDAGGEPPSMTQLLRR

SEQ ID NO: 42788 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKGGVSNKDIEKETAKDAGSEPPSMTQLLRR

SEQ ID NO: 42789 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKGGVSNKDIEKETAKDAGAEPPSMTQLLRR

SEQ ID NO: 42790 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKGGVSNKDIEKETAKDASGEPPSMTQLLRR

SEQ ID NO: 42791 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKGGVSNKDIEKETAKDASSEPPSMTQLLRR

SEQ ID NO: 42792 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKGGVSNKDIEKETAKDASAEPPSMTQLLRR

SEQ ID NO: 42793 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKGGVSNKDIEKETAKDAAGEPPSMTQLLRR

SEQ ID NO: 42794 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKGGVSNKDIEKETAKDAASEPPSMTQLLRR

SEQ ID NO: 42795 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKGGVSNKDIEKETAKDAAAEPPSMTQLLRR

SEQ ID NO: 42796 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKDGVSNKDIEKETAKDGGGEPPSMTQLLRR

SEQ ID NO: 42797 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKDGVSNKDIEKETAKDGGSEPPSMTQLLRR

SEQ ID NO: 42798 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKDGVSNKDIEKETAKDGGAEPPSMTQLLRR

SEQ ID NO: 42799 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKDGVSNKDIEKETAKDGSGEPPSMTQLLRR

SEQ ID NO: 42800 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKDGVSNKDIEKETAKDGSSEPPSMTQLLRR

SEQ ID NO: 42801 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKDGVSNKDIEKETAKDGSAEPPSMTQLLRR

SEQ ID NO: 42802 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKDGVSNKDIEKETAKDGAGEPPSMTQLLRR

SEQ ID NO: 42803 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKDGVSNKDIEKETAKDGASEPPSMTQLLRR

SEQ ID NO: 42804 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKDGVSNKDIEKETAKDGAAEPPSMTQLLRR

SEQ ID NO: 42805 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKDGVSNKDIEKETAKDSGGEPPSMTQLLRR

SEQ ID NO: 42806 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKDGVSNKDIEKETAKDSGSEPPSMTQLLRR

SEQ ID NO: 42807 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKDGVSNKDIEKETAKDSGAEPPSMTQLLRR

SEQ ID NO: 42808 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKDGVSNKDIEKETAKDSSGEPPSMTQLLRR

SEQ ID NO: 42809 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKDGVSNKDIEKETAKDSSSEPPSMTQLLRR

SEQ ID NO: 42810 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKDGVSNKDIEKETAKDSSAEPPSMTQLLRR

SEQ ID NO: 42811 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKDGVSNKDIEKETAKDSAGEPPSMTQLLRR

SEQ ID NO: 42812 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKDGVSNKDIEKETAKDSASEPPSMTQLLRR

SEQ ID NO: 42813 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKDGVSNKDIEKETAKDSAAEPPSMTQLLRR

SEQ ID NO: 42814 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKDGVSNKDIEKETAKDAGGEPPSMTQLLRR

SEQ ID NO: 42815 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKDGVSNKDIEKETAKDAGSEPPSMTQLLRR

SEQ ID NO: 42816 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKDGVSNKDIEKETAKDAGAEPPSMTQLLRR

SEQ ID NO: 42817 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKDGVSNKDIEKETAKDASGEPPSMTQLLRR

SEQ ID NO: 42818 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKDGVSNKDIEKETAKDASSEPPSMTQLLRR

SEQ ID NO: 42819 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKDGVSNKDIEKETAKDASAEPPSMTQLLRR

SEQ ID NO: 42820 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKDGVSNKDIEKETAKDAAGEPPSMTQLLRR

SEQ ID NO: 42821 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKDGVSNKDIEKETAKDAASEPPSMTQLLRR

SEQ ID NO: 42822 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKDGVSNKDIEKETAKDAAAEPPSMTQLLRR

SEQ ID NO: 42823 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKHGVSNKDIEKETAKDGGGEPPSMTQLLRR

SEQ ID NO: 42824 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKHGVSNKDIEKETAKDGGSEPPSMTQLLRR

SEQ ID NO: 42825 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKHGVSNKDIEKETAKDGGAEPPSMTQLLRR

SEQ ID NO: 42826 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKHGVSNKDIEKETAKDGSGEPPSMTQLLRR

SEQ ID NO: 42827 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKHGVSNKDIEKETAKDGSSEPPSMTQLLRR

SEQ ID NO: 42828 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKHGVSNKDIEKETAKDGSAEPPSMTQLLRR

SEQ ID NO: 42829 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKHGVSNKDIEKETAKDGAGEPPSMTQLLRR

SEQ ID NO: 42830 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKHGVSNKDIEKETAKDGASEPPSMTQLLRR

SEQ ID NO: 42831 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKHGVSNKDIEKETAKDGAAEPPSMTQLLRR

SEQ ID NO: 42832 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKHGVSNKDIEKETAKDSGGEPPSMTQLLRR

SEQ ID NO: 42833 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKHGVSNKDIEKETAKDSGSEPPSMTQLLRR

SEQ ID NO: 42834 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKHGVSNKDIEKETAKDSGAEPPSMTQLLRR

SEQ ID NO: 42835 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKHGVSNKDIEKETAKDSSGEPPSMTQLLRR

SEQ ID NO: 42836 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKHGVSNKDIEKETAKDSSSEPPSMTQLLRR

SEQ ID NO: 42837 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKHGVSNKDIEKETAKDSSAEPPSMTQLLRR

SEQ ID NO: 42838 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKHGVSNKDIEKETAKDSAGEPPSMTQLLRR

SEQ ID NO: 42839 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKHGVSNKDIEKETAKDSASEPPSMTQLLRR

SEQ ID NO: 42840 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKHGVSNKDIEKETAKDSAAEPPSMTQLLRR

SEQ ID NO: 42841 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKHGVSNKDIEKETAKDAGGEPPSMTQLLRR

SEQ ID NO: 42842 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKHGVSNKDIEKETAKDAGSEPPSMTQLLRR

SEQ ID NO: 42843 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKHGVSNKDIEKETAKDAGAEPPSMTQLLRR

SEQ ID NO: 42844 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKHGVSNKDIEKETAKDASGEPPSMTQLLRR

SEQ ID NO: 42845 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKHGVSNKDIEKETAKDASSEPPSMTQLLRR

SEQ ID NO: 42846 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKHGVSNKDIEKETAKDASAEPPSMTQLLRR

SEQ ID NO: 42847 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKHGVSNKDIEKETAKDAAGEPPSMTQLLRR

SEQ ID NO: 42848 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKHGVSNKDIEKETAKDAASEPPSMTQLLRR

SEQ ID NO: 42849 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKHGVSNKDIEKETAKDAAAEPPSMTQLLRR

SEQ ID NO: 42850 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKYGVSNKDIEKETAKDGGGEPPSMTQLLRR

SEQ ID NO: 42851 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKYGVSNKDIEKETAKDGGSEPPSMTQLLRR

SEQ ID NO: 42852 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKYGVSNKDIEKETAKDGGAEPPSMTQLLRR

SEQ ID NO: 42853 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKYGVSNKDIEKETAKDGSGEPPSMTQLLRR

SEQ ID NO: 42854 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKYGVSNKDIEKETAKDGSSEPPSMTQLLRR

SEQ ID NO: 42855 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKYGVSNKDIEKETAKDGSAEPPSMTQLLRR

SEQ ID NO: 42856 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKYGVSNKDIEKETAKDGAGEPPSMTQLLRR

SEQ ID NO: 42857 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKYGVSNKDIEKETAKDGASEPPSMTQLLRR

SEQ ID NO: 42858 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKYGVSNKDIEKETAKDGAAEPPSMTQLLRR

SEQ ID NO: 42859 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKYGVSNKDIEKETAKDSGGEPPSMTQLLRR

SEQ ID NO: 42860 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKYGVSNKDIEKETAKDSGSEPPSMTQLLRR

SEQ ID NO: 42861 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKYGVSNKDIEKETAKDSGAEPPSMTQLLRR

SEQ ID NO: 42862 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKYGVSNKDIEKETAKDSSGEPPSMTQLLRR

SEQ ID NO: 42863 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKYGVSNKDIEKETAKDSSSEPPSMTQLLRR

SEQ ID NO: 42864 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKYGVSNKDIEKETAKDSSAEPPSMTQLLRR

SEQ ID NO: 42865 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKYGVSNKDIEKETAKDSAGEPPSMTQLLRR

SEQ ID NO: 42866 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKYGVSNKDIEKETAKDSASEPPSMTQLLRR

SEQ ID NO: 42867 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKYGVSNKDIEKETAKDSAAEPPSMTQLLRR

SEQ ID NO: 42868 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKYGVSNKDIEKETAKDAGGEPPSMTQLLRR

SEQ ID NO: 42869 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKYGVSNKDIEKETAKDAGSEPPSMTQLLRR

SEQ ID NO: 42870 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKYGVSNKDIEKETAKDAGAEPPSMTQLLRR

SEQ ID NO: 42871 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKYGVSNKDIEKETAKDASGEPPSMTQLLRR

SEQ ID NO: 42872 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKYGVSNKDIEKETAKDASSEPPSMTQLLRR

SEQ ID NO: 42873 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKYGVSNKDIEKETAKDASAEPPSMTQLLRR

SEQ ID NO: 42874 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKYGVSNKDIEKETAKDAAGEPPSMTQLLRR

SEQ ID NO: 42875 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKYGVSNKDIEKETAKDAASEPPSMTQLLRR

SEQ ID NO: 42876 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKYGVSNKDIEKETAKDAAAEPPSMTQLLRR

SEQ ID NO: 42877 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKKGVSNKDIEKETAKDGGGEPPSMTQLLRR

SEQ ID NO: 42878 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKKGVSNKDIEKETAKDGGSEPPSMTQLLRR

SEQ ID NO: 42879 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKKGVSNKDIEKETAKDGGAEPPSMTQLLRR

SEQ ID NO: 42880 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKKGVSNKDIEKETAKDGSGEPPSMTQLLRR

SEQ ID NO: 42881 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKKGVSNKDIEKETAKDGSSEPPSMTQLLRR

SEQ ID NO: 42882 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKKGVSNKDIEKETAKDGSAEPPSMTQLLRR

SEQ ID NO: 42883 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKKGVSNKDIEKETAKDGAGEPPSMTQLLRR

SEQ ID NO: 42884 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKKGVSNKDIEKETAKDGASEPPSMTQLLRR

SEQ ID NO: 42885 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKKGVSNKDIEKETAKDGAAEPPSMTQLLRR

SEQ ID NO: 42886 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKKGVSNKDIEKETAKDSGGEPPSMTQLLRR

SEQ ID NO: 42887 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKKGVSNKDIEKETAKDSGSEPPSMTQLLRR

SEQ ID NO: 42888 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKKGVSNKDIEKETAKDSGAEPPSMTQLLRR

SEQ ID NO: 42889 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKKGVSNKDIEKETAKDSSGEPPSMTQLLRR

SEQ ID NO: 42890 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKKGVSNKDIEKETAKDSSSEPPSMTQLLRR

SEQ ID NO: 42891 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKKGVSNKDIEKETAKDSSAEPPSMTQLLRR

SEQ ID NO: 42892 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKKGVSNKDIEKETAKDSAGEPPSMTQLLRR

SEQ ID NO: 42893 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKKGVSNKDIEKETAKDSASEPPSMTQLLRR

SEQ ID NO: 42894 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKKGVSNKDIEKETAKDSAAEPPSMTQLLRR

SEQ ID NO: 42895 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKKGVSNKDIEKETAKDAGGEPPSMTQLLRR

SEQ ID NO: 42896 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKKGVSNKDIEKETAKDAGSEPPSMTQLLRR

SEQ ID NO: 42897 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKKGVSNKDIEKETAKDAGAEPPSMTQLLRR

SEQ ID NO: 42898 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKKGVSNKDIEKETAKDASGEPPSMTQLLRR

SEQ ID NO: 42899 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKKGVSNKDIEKETAKDASSEPPSMTQLLRR

SEQ ID NO: 42900 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKKGVSNKDIEKETAKDASAEPPSMTQLLRR

SEQ ID NO: 42901 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKKGVSNKDIEKETAKDAAGEPPSMTQLLRR

SEQ ID NO: 42902 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKKGVSNKDIEKETAKDAASEPPSMTQLLRR

SEQ ID NO: 42903 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKKGVSNKDIEKETAKDAAAEPPSMTQLLRR

SEQ ID NO: 42904 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKNGVSNKDIEKETAKDGGGEPPSMTQLLRR

SEQ ID NO: 42905 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKNGVSNKDIEKETAKDGGSEPPSMTQLLRR

SEQ ID NO: 42906 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKNGVSNKDIEKETAKDGGAEPPSMTQLLRR

SEQ ID NO: 42907 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKNGVSNKDIEKETAKDGSGEPPSMTQLLRR

SEQ ID NO: 42908 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKNGVSNKDIEKETAKDGSSEPPSMTQLLRR

SEQ ID NO: 42909 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKNGVSNKDIEKETAKDGSAEPPSMTQLLRR

SEQ ID NO: 42910 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKNGVSNKDIEKETAKDGAGEPPSMTQLLRR

SEQ ID NO: 42911 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKNGVSNKDIEKETAKDGASEPPSMTQLLRR

SEQ ID NO: 42912 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKNGVSNKDIEKETAKDGAAEPPSMTQLLRR

SEQ ID NO: 42913 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKNGVSNKDIEKETAKDSGGEPPSMTQLLRR

SEQ ID NO: 42914 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKNGVSNKDIEKETAKDSGSEPPSMTQLLRR

SEQ ID NO: 42915 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKNGVSNKDIEKETAKDSGAEPPSMTQLLRR

SEQ ID NO: 42916 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKNGVSNKDIEKETAKDSSGEPPSMTQLLRR

SEQ ID NO: 42917 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKNGVSNKDIEKETAKDSSSEPPSMTQLLRR

SEQ ID NO: 42918 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKNGVSNKDIEKETAKDSSAEPPSMTQLLRR

SEQ ID NO: 42919 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKNGVSNKDIEKETAKDSAGEPPSMTQLLRR

SEQ ID NO: 42920 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKNGVSNKDIEKETAKDSASEPPSMTQLLRR

SEQ ID NO: 42921 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKNGVSNKDIEKETAKDSAAEPPSMTQLLRR

SEQ ID NO: 42922 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKNGVSNKDIEKETAKDAGGEPPSMTQLLRR

SEQ ID NO: 42923 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKNGVSNKDIEKETAKDAGSEPPSMTQLLRR

SEQ ID NO: 42924 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKNGVSNKDIEKETAKDAGAEPPSMTQLLRR

SEQ ID NO: 42925 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKNGVSNKDIEKETAKDASGEPPSMTQLLRR

SEQ ID NO: 42926 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKNGVSNKDIEKETAKDASSEPPSMTQLLRR

SEQ ID NO: 42927 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKNGVSNKDIEKETAKDASAEPPSMTQLLRR

SEQ ID NO: 42928 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKNGVSNKDIEKETAKDAAGEPPSMTQLLRR

SEQ ID NO: 42929 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKNGVSNKDIEKETAKDAASEPPSMTQLLRR

SEQ ID NO: 42930 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKNGVSNKDIEKETAKDAAAEPPSMTQLLRR

SEQ ID NO: 42931 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKMGVSNKDIEKETAKDGGGEPPSMTQLLRR

SEQ ID NO: 42932 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKMGVSNKDIEKETAKDGGSEPPSMTQLLRR

SEQ ID NO: 42933 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKMGVSNKDIEKETAKDGGAEPPSMTQLLRR

SEQ ID NO: 42934 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKMGVSNKDIEKETAKDGSGEPPSMTQLLRR

SEQ ID NO: 42935 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKMGVSNKDIEKETAKDGSSEPPSMTQLLRR

SEQ ID NO: 42936 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKMGVSNKDIEKETAKDGSAEPPSMTQLLRR

SEQ ID NO: 42937 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKMGVSNKDIEKETAKDGAGEPPSMTQLLRR

SEQ ID NO: 42938 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKMGVSNKDIEKETAKDGASEPPSMTQLLRR

SEQ ID NO: 42939 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKMGVSNKDIEKETAKDGAAEPPSMTQLLRR

SEQ ID NO: 42940 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKMGVSNKDIEKETAKDSGGEPPSMTQLLRR

SEQ ID NO: 42941 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKMGVSNKDIEKETAKDSGSEPPSMTQLLRR

SEQ ID NO: 42942 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKMGVSNKDIEKETAKDSGAEPPSMTQLLRR

SEQ ID NO: 42943 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKMGVSNKDIEKETAKDSSGEPPSMTQLLRR

SEQ ID NO: 42944 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKMGVSNKDIEKETAKDSSSEPPSMTQLLRR

SEQ ID NO: 42945 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKMGVSNKDIEKETAKDSSAEPPSMTQLLRR

SEQ ID NO: 42946 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKMGVSNKDIEKETAKDSAGEPPSMTQLLRR

SEQ ID NO: 42947 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKMGVSNKDIEKETAKDSASEPPSMTQLLRR

SEQ ID NO: 42948 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKMGVSNKDIEKETAKDSAAEPPSMTQLLRR

SEQ ID NO: 42949 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKMGVSNKDIEKETAKDAGGEPPSMTQLLRR

SEQ ID NO: 42950 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKMGVSNKDIEKETAKDAGSEPPSMTQLLRR

SEQ ID NO: 42951 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKMGVSNKDIEKETAKDAGAEPPSMTQLLRR

SEQ ID NO: 42952 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKMGVSNKDIEKETAKDASGEPPSMTQLLRR

SEQ ID NO: 42953 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKMGVSNKDIEKETAKDASSEPPSMTQLLRR

SEQ ID NO: 42954 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKMGVSNKDIEKETAKDASAEPPSMTQLLRR

SEQ ID NO: 42955 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKMGVSNKDIEKETAKDAAGEPPSMTQLLRR

SEQ ID NO: 42956 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKMGVSNKDIEKETAKDAASEPPSMTQLLRR

SEQ ID NO: 42957 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKMGVSNKDIEKETAKDAAAEPPSMTQLLRR

SEQ ID NO: 42958 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKCGVSNKDIEKETAKDGGGEPPSMTQLLRR

SEQ ID NO: 42959 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKCGVSNKDIEKETAKDGGSEPPSMTQLLRR

SEQ ID NO: 42960 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKCGVSNKDIEKETAKDGGAEPPSMTQLLRR

SEQ ID NO: 42961 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKCGVSNKDIEKETAKDGSGEPPSMTQLLRR

SEQ ID NO: 42962 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKCGVSNKDIEKETAKDGSSEPPSMTQLLRR

SEQ ID NO: 42963 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKCGVSNKDIEKETAKDGSAEPPSMTQLLRR

SEQ ID NO: 42964 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKCGVSNKDIEKETAKDGAGEPPSMTQLLRR

SEQ ID NO: 42965 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKCGVSNKDIEKETAKDGASEPPSMTQLLRR

SEQ ID NO: 42966 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKCGVSNKDIEKETAKDGAAEPPSMTQLLRR

SEQ ID NO: 42967 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKCGVSNKDIEKETAKDSGGEPPSMTQLLRR

SEQ ID NO: 42968 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKCGVSNKDIEKETAKDSGSEPPSMTQLLRR

SEQ ID NO: 42969 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKCGVSNKDIEKETAKDSGAEPPSMTQLLRR

SEQ ID NO: 42970 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKCGVSNKDIEKETAKDSSGEPPSMTQLLRR

SEQ ID NO: 42971 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKCGVSNKDIEKETAKDSSSEPPSMTQLLRR

SEQ ID NO: 42972 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKCGVSNKDIEKETAKDSSAEPPSMTQLLRR

SEQ ID NO: 42973 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKCGVSNKDIEKETAKDSAGEPPSMTQLLRR

SEQ ID NO: 42974 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKCGVSNKDIEKETAKDSASEPPSMTQLLRR

SEQ ID NO: 42975 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKCGVSNKDIEKETAKDSAAEPPSMTQLLRR

SEQ ID NO: 42976 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKCGVSNKDIEKETAKDAGGEPPSMTQLLRR

SEQ ID NO: 42977 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKCGVSNKDIEKETAKDAGSEPPSMTQLLRR

SEQ ID NO: 42978 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKCGVSNKDIEKETAKDAGAEPPSMTQLLRR

SEQ ID NO: 42979 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKCGVSNKDIEKETAKDASGEPPSMTQLLRR

SEQ ID NO: 42980 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKCGVSNKDIEKETAKDASSEPPSMTQLLRR

SEQ ID NO: 42981 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKCGVSNKDIEKETAKDASAEPPSMTQLLRR

SEQ ID NO: 42982 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKCGVSNKDIEKETAKDAAGEPPSMTQLLRR

SEQ ID NO: 42983 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKCGVSNKDIEKETAKDAASEPPSMTQLLRR

SEQ ID NO: 42984 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKCGVSNKDIEKETAKDAAAEPPSMTQLLRR

SEQ ID NO: 42985 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKSGVSNKDIEKETAKDGGGEPPSMTQLLRR

SEQ ID NO: 42986 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKSGVSNKDIEKETAKDGGSEPPSMTQLLRR

SEQ ID NO: 42987 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKSGVSNKDIEKETAKDGGAEPPSMTQLLRR

SEQ ID NO: 42988 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKSGVSNKDIEKETAKDGSGEPPSMTQLLRR

SEQ ID NO: 42989 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKSGVSNKDIEKETAKDGSSEPPSMTQLLRR

SEQ ID NO: 42990 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKSGVSNKDIEKETAKDGSAEPPSMTQLLRR

SEQ ID NO: 42991 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKSGVSNKDIEKETAKDGAGEPPSMTQLLRR

SEQ ID NO: 42992 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKSGVSNKDIEKETAKDGASEPPSMTQLLRR

SEQ ID NO: 42993 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKSGVSNKDIEKETAKDGAAEPPSMTQLLRR

SEQ ID NO: 42994 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKSGVSNKDIEKETAKDSGGEPPSMTQLLRR

SEQ ID NO: 42995 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKSGVSNKDIEKETAKDSGSEPPSMTQLLRR

SEQ ID NO: 42996 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKSGVSNKDIEKETAKDSGAEPPSMTQLLRR

SEQ ID NO: 42997 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKSGVSNKDIEKETAKDSSGEPPSMTQLLRR

SEQ ID NO: 42998 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKSGVSNKDIEKETAKDSSSEPPSMTQLLRR

SEQ ID NO: 42999 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKSGVSNKDIEKETAKDSSAEPPSMTQLLRR

SEQ ID NO: 43000 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKSGVSNKDIEKETAKDSAGEPPSMTQLLRR

SEQ ID NO: 43001 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKSGVSNKDIEKETAKDSASEPPSMTQLLRR

SEQ ID NO: 43002 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKSGVSNKDIEKETAKDSAAEPPSMTQLLRR

SEQ ID NO: 43003 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKSGVSNKDIEKETAKDAGGEPPSMTQLLRR

SEQ ID NO: 43004 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKSGVSNKDIEKETAKDAGSEPPSMTQLLRR

SEQ ID NO: 43005 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKSGVSNKDIEKETAKDAGAEPPSMTQLLRR

SEQ ID NO: 43006 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKSGVSNKDIEKETAKDASGEPPSMTQLLRR

SEQ ID NO: 43007 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKSGVSNKDIEKETAKDASSEPPSMTQLLRR

SEQ ID NO: 43008 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKSGVSNKDIEKETAKDASAEPPSMTQLLRR

SEQ ID NO: 43009 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKSGVSNKDIEKETAKDAAGEPPSMTQLLRR

SEQ ID NO: 43010 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKSGVSNKDIEKETAKDAASEPPSMTQLLRR

SEQ ID NO: 43011 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKSGVSNKDIEKETAKDAAAEPPSMTQLLRR

SEQ ID NO: 43012 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKAGVSNKDIEKETAKDGGGEPPSMTQLLRR

SEQ ID NO: 43013 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKAGVSNKDIEKETAKDGGSEPPSMTQLLRR

SEQ ID NO: 43014 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKAGVSNKDIEKETAKDGGAEPPSMTQLLRR

SEQ ID NO: 43015 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKAGVSNKDIEKETAKDGSGEPPSMTQLLRR

SEQ ID NO: 43016 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKAGVSNKDIEKETAKDGSSEPPSMTQLLRR

SEQ ID NO: 43017 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKAGVSNKDIEKETAKDGSAEPPSMTQLLRR

SEQ ID NO: 43018 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKAGVSNKDIEKETAKDGAGEPPSMTQLLRR

SEQ ID NO: 43019 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKAGVSNKDIEKETAKDGASEPPSMTQLLRR

SEQ ID NO: 43020 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKAGVSNKDIEKETAKDGAAEPPSMTQLLRR

SEQ ID NO: 43021 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKAGVSNKDIEKETAKDSGGEPPSMTQLLRR

SEQ ID NO: 43022 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKAGVSNKDIEKETAKDSGSEPPSMTQLLRR

SEQ ID NO: 43023 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKAGVSNKDIEKETAKDSGAEPPSMTQLLRR

SEQ ID NO: 43024 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKAGVSNKDIEKETAKDSSGEPPSMTQLLRR

SEQ ID NO: 43025 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKAGVSNKDIEKETAKDSSSEPPSMTQLLRR

SEQ ID NO: 43026 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKAGVSNKDIEKETAKDSSAEPPSMTQLLRR

SEQ ID NO: 43027 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKAGVSNKDIEKETAKDSAGEPPSMTQLLRR

SEQ ID NO: 43028 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKAGVSNKDIEKETAKDSASEPPSMTQLLRR

SEQ ID NO: 43029 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKAGVSNKDIEKETAKDSAAEPPSMTQLLRR

SEQ ID NO: 43030 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKAGVSNKDIEKETAKDAGGEPPSMTQLLRR

SEQ ID NO: 43031 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKAGVSNKDIEKETAKDAGSEPPSMTQLLRR

SEQ ID NO: 43032 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKAGVSNKDIEKETAKDAGAEPPSMTQLLRR

SEQ ID NO: 43033 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKAGVSNKDIEKETAKDASGEPPSMTQLLRR

SEQ ID NO: 43034 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKAGVSNKDIEKETAKDASSEPPSMTQLLRR

SEQ ID NO: 43035 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKAGVSNKDIEKETAKDASAEPPSMTQLLRR

SEQ ID NO: 43036 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKAGVSNKDIEKETAKDAAGEPPSMTQLLRR

SEQ ID NO: 43037 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKAGVSNKDIEKETAKDAASEPPSMTQLLRR

SEQ ID NO: 43038 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKAGVSNKDIEKETAKDAAAEPPSMTQLLRR

SEQ ID NO: 43039 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKGGVSNKDIEKETAKDGGGEPPSMTQLLRR

SEQ ID NO: 43040 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKGGVSNKDIEKETAKDGGSEPPSMTQLLRR

SEQ ID NO: 43041 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKGGVSNKDIEKETAKDGGAEPPSMTQLLRR

SEQ ID NO: 43042 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKGGVSNKDIEKETAKDGSGEPPSMTQLLRR

SEQ ID NO: 43043 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKGGVSNKDIEKETAKDGSSEPPSMTQLLRR

SEQ ID NO: 43044 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKGGVSNKDIEKETAKDGSAEPPSMTQLLRR

SEQ ID NO: 43045 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKGGVSNKDIEKETAKDGAGEPPSMTQLLRR

SEQ ID NO: 43046 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKGGVSNKDIEKETAKDGASEPPSMTQLLRR

SEQ ID NO: 43047 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKGGVSNKDIEKETAKDGAAEPPSMTQLLRR

SEQ ID NO: 43048 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKGGVSNKDIEKETAKDSGGEPPSMTQLLRR

SEQ ID NO: 43049 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKGGVSNKDIEKETAKDSGSEPPSMTQLLRR

SEQ ID NO: 43050 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKGGVSNKDIEKETAKDSGAEPPSMTQLLRR

SEQ ID NO: 43051 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKGGVSNKDIEKETAKDSSGEPPSMTQLLRR

SEQ ID NO: 43052 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKGGVSNKDIEKETAKDSSSEPPSMTQLLRR

SEQ ID NO: 43053 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKGGVSNKDIEKETAKDSSAEPPSMTQLLRR

SEQ ID NO: 43054 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKGGVSNKDIEKETAKDSAGEPPSMTQLLRR

SEQ ID NO: 43055 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKGGVSNKDIEKETAKDSASEPPSMTQLLRR

SEQ ID NO: 43056 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKGGVSNKDIEKETAKDSAAEPPSMTQLLRR

SEQ ID NO: 43057 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKGGVSNKDIEKETAKDAGGEPPSMTQLLRR

SEQ ID NO: 43058 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKGGVSNKDIEKETAKDAGSEPPSMTQLLRR

SEQ ID NO: 43059 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKGGVSNKDIEKETAKDAGAEPPSMTQLLRR

SEQ ID NO: 43060 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKGGVSNKDIEKETAKDASGEPPSMTQLLRR

SEQ ID NO: 43061 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKGGVSNKDIEKETAKDASSEPPSMTQLLRR

SEQ ID NO: 43062 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKGGVSNKDIEKETAKDASAEPPSMTQLLRR

SEQ ID NO: 43063 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKGGVSNKDIEKETAKDAAGEPPSMTQLLRR

SEQ ID NO: 43064 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKGGVSNKDIEKETAKDAASEPPSMTQLLRR

SEQ ID NO: 43065 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKGGVSNKDIEKETAKDAAAEPPSMTQLLRR

SEQ ID NO: 43066 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKDGVSNKDIEKETAKDGGGEPPSMTQLLRR

SEQ ID NO: 43067 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKDGVSNKDIEKETAKDGGSEPPSMTQLLRR

SEQ ID NO: 43068 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKDGVSNKDIEKETAKDGGAEPPSMTQLLRR

SEQ ID NO: 43069 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKDGVSNKDIEKETAKDGSGEPPSMTQLLRR

SEQ ID NO: 43070 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKDGVSNKDIEKETAKDGSSEPPSMTQLLRR

SEQ ID NO: 43071 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKDGVSNKDIEKETAKDGSAEPPSMTQLLRR

SEQ ID NO: 43072 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKDGVSNKDIEKETAKDGAGEPPSMTQLLRR

SEQ ID NO: 43073 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKDGVSNKDIEKETAKDGASEPPSMTQLLRR

SEQ ID NO: 43074 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKDGVSNKDIEKETAKDGAAEPPSMTQLLRR

SEQ ID NO: 43075 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKDGVSNKDIEKETAKDSGGEPPSMTQLLRR

SEQ ID NO: 43076 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKDGVSNKDIEKETAKDSGSEPPSMTQLLRR

SEQ ID NO: 43077 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKDGVSNKDIEKETAKDSGAEPPSMTQLLRR

SEQ ID NO: 43078 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKDGVSNKDIEKETAKDSSGEPPSMTQLLRR

SEQ ID NO: 43079 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKDGVSNKDIEKETAKDSSSEPPSMTQLLRR

SEQ ID NO: 43080 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKDGVSNKDIEKETAKDSSAEPPSMTQLLRR

SEQ ID NO: 43081 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKDGVSNKDIEKETAKDSAGEPPSMTQLLRR

SEQ ID NO: 43082 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKDGVSNKDIEKETAKDSASEPPSMTQLLRR

SEQ ID NO: 43083 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKDGVSNKDIEKETAKDSAAEPPSMTQLLRR

SEQ ID NO: 43084 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKDGVSNKDIEKETAKDAGGEPPSMTQLLRR

SEQ ID NO: 43085 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKDGVSNKDIEKETAKDAGSEPPSMTQLLRR

SEQ ID NO: 43086 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKDGVSNKDIEKETAKDAGAEPPSMTQLLRR

SEQ ID NO: 43087 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKDGVSNKDIEKETAKDASGEPPSMTQLLRR

SEQ ID NO: 43088 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKDGVSNKDIEKETAKDASSEPPSMTQLLRR

SEQ ID NO: 43089 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKDGVSNKDIEKETAKDASAEPPSMTQLLRR

SEQ ID NO: 43090 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKDGVSNKDIEKETAKDAAGEPPSMTQLLRR

SEQ ID NO: 43091 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKDGVSNKDIEKETAKDAASEPPSMTQLLRR

SEQ ID NO: 43092 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKDGVSNKDIEKETAKDAAAEPPSMTQLLRR

SEQ ID NO: 43093 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKHGVSNKDIEKETAKDGGGEPPSMTQLLRR

SEQ ID NO: 43094 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKHGVSNKDIEKETAKDGGSEPPSMTQLLRR

SEQ ID NO: 43095 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKHGVSNKDIEKETAKDGGAEPPSMTQLLRR

SEQ ID NO: 43096 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKHGVSNKDIEKETAKDGSGEPPSMTQLLRR

SEQ ID NO: 43097 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKHGVSNKDIEKETAKDGSSEPPSMTQLLRR

SEQ ID NO: 43098 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKHGVSNKDIEKETAKDGSAEPPSMTQLLRR

SEQ ID NO: 43099 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKHGVSNKDIEKETAKDGAGEPPSMTQLLRR

SEQ ID NO: 43100 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKHGVSNKDIEKETAKDGASEPPSMTQLLRR

SEQ ID NO: 43101 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKHGVSNKDIEKETAKDGAAEPPSMTQLLRR

SEQ ID NO: 43102 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKHGVSNKDIEKETAKDSGGEPPSMTQLLRR

SEQ ID NO: 43103 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKHGVSNKDIEKETAKDSGSEPPSMTQLLRR

SEQ ID NO: 43104 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKHGVSNKDIEKETAKDSGAEPPSMTQLLRR

SEQ ID NO: 43105 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKHGVSNKDIEKETAKDSSGEPPSMTQLLRR

SEQ ID NO: 43106 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKHGVSNKDIEKETAKDSSSEPPSMTQLLRR

SEQ ID NO: 43107 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKHGVSNKDIEKETAKDSSAEPPSMTQLLRR

SEQ ID NO: 43108 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKHGVSNKDIEKETAKDSAGEPPSMTQLLRR

SEQ ID NO: 43109 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKHGVSNKDIEKETAKDSASEPPSMTQLLRR

SEQ ID NO: 43110 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKHGVSNKDIEKETAKDSAAEPPSMTQLLRR

SEQ ID NO: 43111 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKHGVSNKDIEKETAKDAGGEPPSMTQLLRR

SEQ ID NO: 43112 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKHGVSNKDIEKETAKDAGSEPPSMTQLLRR

SEQ ID NO: 43113 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKHGVSNKDIEKETAKDAGAEPPSMTQLLRR

SEQ ID NO: 43114 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKHGVSNKDIEKETAKDASGEPPSMTQLLRR

SEQ ID NO: 43115 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKHGVSNKDIEKETAKDASSEPPSMTQLLRR

SEQ ID NO: 43116 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKHGVSNKDIEKETAKDASAEPPSMTQLLRR

SEQ ID NO: 43117 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKHGVSNKDIEKETAKDAAGEPPSMTQLLRR

SEQ ID NO: 43118 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKHGVSNKDIEKETAKDAASEPPSMTQLLRR

SEQ ID NO: 43119 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKHGVSNKDIEKETAKDAAAEPPSMTQLLRR

SEQ ID NO: 43120 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKYGVSNKDIEKETAKDGGGEPPSMTQLLRR

SEQ ID NO: 43121 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKYGVSNKDIEKETAKDGGSEPPSMTQLLRR

SEQ ID NO: 43122 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKYGVSNKDIEKETAKDGGAEPPSMTQLLRR

SEQ ID NO: 43123 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKYGVSNKDIEKETAKDGSGEPPSMTQLLRR

SEQ ID NO: 43124 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKYGVSNKDIEKETAKDGSSEPPSMTQLLRR

SEQ ID NO: 43125 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKYGVSNKDIEKETAKDGSAEPPSMTQLLRR

SEQ ID NO: 43126 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKYGVSNKDIEKETAKDGAGEPPSMTQLLRR

SEQ ID NO: 43127 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKYGVSNKDIEKETAKDGASEPPSMTQLLRR

SEQ ID NO: 43128 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKYGVSNKDIEKETAKDGAAEPPSMTQLLRR

SEQ ID NO: 43129 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKYGVSNKDIEKETAKDSGGEPPSMTQLLRR

SEQ ID NO: 43130 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKYGVSNKDIEKETAKDSGSEPPSMTQLLRR

SEQ ID NO: 43131 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKYGVSNKDIEKETAKDSGAEPPSMTQLLRR

SEQ ID NO: 43132 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKYGVSNKDIEKETAKDSSGEPPSMTQLLRR

SEQ ID NO: 43133 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKYGVSNKDIEKETAKDSSSEPPSMTQLLRR

SEQ ID NO: 43134 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKYGVSNKDIEKETAKDSSAEPPSMTQLLRR

SEQ ID NO: 43135 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKYGVSNKDIEKETAKDSAGEPPSMTQLLRR

SEQ ID NO: 43136 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKYGVSNKDIEKETAKDSASEPPSMTQLLRR

SEQ ID NO: 43137 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKYGVSNKDIEKETAKDSAAEPPSMTQLLRR

SEQ ID NO: 43138 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKYGVSNKDIEKETAKDAGGEPPSMTQLLRR

SEQ ID NO: 43139 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKYGVSNKDIEKETAKDAGSEPPSMTQLLRR

SEQ ID NO: 43140 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKYGVSNKDIEKETAKDAGAEPPSMTQLLRR

SEQ ID NO: 43141 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKYGVSNKDIEKETAKDASGEPPSMTQLLRR

SEQ ID NO: 43142 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKYGVSNKDIEKETAKDASSEPPSMTQLLRR

SEQ ID NO: 43143 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKYGVSNKDIEKETAKDASAEPPSMTQLLRR

SEQ ID NO: 43144 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKYGVSNKDIEKETAKDAAGEPPSMTQLLRR

SEQ ID NO: 43145 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKYGVSNKDIEKETAKDAASEPPSMTQLLRR

SEQ ID NO: 43146 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKYGVSNKDIEKETAKDAAAEPPSMTQLLRR

SEQ ID NO: 43147 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKKGVSNKDIEKETAKDGGGEPPSMTQLLRR

SEQ ID NO: 43148 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKKGVSNKDIEKETAKDGGSEPPSMTQLLRR

SEQ ID NO: 43149 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKKGVSNKDIEKETAKDGGAEPPSMTQLLRR

SEQ ID NO: 43150 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKKGVSNKDIEKETAKDGSGEPPSMTQLLRR

SEQ ID NO: 43151 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKKGVSNKDIEKETAKDGSSEPPSMTQLLRR

SEQ ID NO: 43152 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKKGVSNKDIEKETAKDGSAEPPSMTQLLRR

SEQ ID NO: 43153 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKKGVSNKDIEKETAKDGAGEPPSMTQLLRR

SEQ ID NO: 43154 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKKGVSNKDIEKETAKDGASEPPSMTQLLRR

SEQ ID NO: 43155 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKKGVSNKDIEKETAKDGAAEPPSMTQLLRR

SEQ ID NO: 43156 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKKGVSNKDIEKETAKDSGGEPPSMTQLLRR

SEQ ID NO: 43157 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKKGVSNKDIEKETAKDSGSEPPSMTQLLRR

SEQ ID NO: 43158 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKKGVSNKDIEKETAKDSGAEPPSMTQLLRR

SEQ ID NO: 43159 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKKGVSNKDIEKETAKDSSGEPPSMTQLLRR

SEQ ID NO: 43160 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKKGVSNKDIEKETAKDSSSEPPSMTQLLRR

SEQ ID NO: 43161 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKKGVSNKDIEKETAKDSSAEPPSMTQLLRR

SEQ ID NO: 43162 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKKGVSNKDIEKETAKDSAGEPPSMTQLLRR

SEQ ID NO: 43163 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKKGVSNKDIEKETAKDSASEPPSMTQLLRR

SEQ ID NO: 43164 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKKGVSNKDIEKETAKDSAAEPPSMTQLLRR

SEQ ID NO: 43165 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKKGVSNKDIEKETAKDAGGEPPSMTQLLRR

SEQ ID NO: 43166 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKKGVSNKDIEKETAKDAGSEPPSMTQLLRR

SEQ ID NO: 43167 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKKGVSNKDIEKETAKDAGAEPPSMTQLLRR

SEQ ID NO: 43168 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKKGVSNKDIEKETAKDASGEPPSMTQLLRR

SEQ ID NO: 43169 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKKGVSNKDIEKETAKDASSEPPSMTQLLRR

SEQ ID NO: 43170 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKKGVSNKDIEKETAKDASAEPPSMTQLLRR

SEQ ID NO: 43171 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKKGVSNKDIEKETAKDAAGEPPSMTQLLRR

SEQ ID NO: 43172 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKKGVSNKDIEKETAKDAASEPPSMTQLLRR

SEQ ID NO: 43173 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKKGVSNKDIEKETAKDAAAEPPSMTQLLRR

SEQ ID NO: 43174 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKNGVSNKDIEKETAKDGGGEPPSMTQLLRR

SEQ ID NO: 43175 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKNGVSNKDIEKETAKDGGSEPPSMTQLLRR

SEQ ID NO: 43176 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKNGVSNKDIEKETAKDGGAEPPSMTQLLRR

SEQ ID NO: 43177 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKNGVSNKDIEKETAKDGSGEPPSMTQLLRR

SEQ ID NO: 43178 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKNGVSNKDIEKETAKDGSSEPPSMTQLLRR

SEQ ID NO: 43179 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKNGVSNKDIEKETAKDGSAEPPSMTQLLRR

SEQ ID NO: 43180 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKNGVSNKDIEKETAKDGAGEPPSMTQLLRR

SEQ ID NO: 43181 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKNGVSNKDIEKETAKDGASEPPSMTQLLRR

SEQ ID NO: 43182 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKNGVSNKDIEKETAKDGAAEPPSMTQLLRR

SEQ ID NO: 43183 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKNGVSNKDIEKETAKDSGGEPPSMTQLLRR

SEQ ID NO: 43184 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKNGVSNKDIEKETAKDSGSEPPSMTQLLRR

SEQ ID NO: 43185 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKNGVSNKDIEKETAKDSGAEPPSMTQLLRR

SEQ ID NO: 43186 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKNGVSNKDIEKETAKDSSGEPPSMTQLLRR

SEQ ID NO: 43187 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKNGVSNKDIEKETAKDSSSEPPSMTQLLRR

SEQ ID NO: 43188 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKNGVSNKDIEKETAKDSSAEPPSMTQLLRR

SEQ ID NO: 43189 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKNGVSNKDIEKETAKDSAGEPPSMTQLLRR

SEQ ID NO: 43190 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKNGVSNKDIEKETAKDSASEPPSMTQLLRR

SEQ ID NO: 43191 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKNGVSNKDIEKETAKDSAAEPPSMTQLLRR

SEQ ID NO: 43192 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKNGVSNKDIEKETAKDAGGEPPSMTQLLRR

SEQ ID NO: 43193 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKNGVSNKDIEKETAKDAGSEPPSMTQLLRR

SEQ ID NO: 43194 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKNGVSNKDIEKETAKDAGAEPPSMTQLLRR

SEQ ID NO: 43195 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKNGVSNKDIEKETAKDASGEPPSMTQLLRR

SEQ ID NO: 43196 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKNGVSNKDIEKETAKDASSEPPSMTQLLRR

SEQ ID NO: 43197 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKNGVSNKDIEKETAKDASAEPPSMTQLLRR

SEQ ID NO: 43198 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKNGVSNKDIEKETAKDAAGEPPSMTQLLRR

SEQ ID NO: 43199 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKNGVSNKDIEKETAKDAASEPPSMTQLLRR

SEQ ID NO: 43200 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKNGVSNKDIEKETAKDAAAEPPSMTQLLRR

SEQ ID NO: 43201 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKMGVSNKDIEKETAKDGGGEPPSMTQLLRR

SEQ ID NO: 43202 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKMGVSNKDIEKETAKDGGSEPPSMTQLLRR

SEQ ID NO: 43203 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKMGVSNKDIEKETAKDGGAEPPSMTQLLRR

SEQ ID NO: 43204 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKMGVSNKDIEKETAKDGSGEPPSMTQLLRR

SEQ ID NO: 43205 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKMGVSNKDIEKETAKDGSSEPPSMTQLLRR

SEQ ID NO: 43206 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKMGVSNKDIEKETAKDGSAEPPSMTQLLRR

SEQ ID NO: 43207 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKMGVSNKDIEKETAKDGAGEPPSMTQLLRR

SEQ ID NO: 43208 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKMGVSNKDIEKETAKDGASEPPSMTQLLRR

SEQ ID NO: 43209 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKMGVSNKDIEKETAKDGAAEPPSMTQLLRR

SEQ ID NO: 43210 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKMGVSNKDIEKETAKDSGGEPPSMTQLLRR

SEQ ID NO: 43211 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKMGVSNKDIEKETAKDSGSEPPSMTQLLRR

SEQ ID NO: 43212 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKMGVSNKDIEKETAKDSGAEPPSMTQLLRR

SEQ ID NO: 43213 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKMGVSNKDIEKETAKDSSGEPPSMTQLLRR

SEQ ID NO: 43214 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKMGVSNKDIEKETAKDSSSEPPSMTQLLRR

SEQ ID NO: 43215 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKMGVSNKDIEKETAKDSSAEPPSMTQLLRR

SEQ ID NO: 43216 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKMGVSNKDIEKETAKDSAGEPPSMTQLLRR

SEQ ID NO: 43217 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKMGVSNKDIEKETAKDSASEPPSMTQLLRR

SEQ ID NO: 43218 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKMGVSNKDIEKETAKDSAAEPPSMTQLLRR

SEQ ID NO: 43219 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKMGVSNKDIEKETAKDAGGEPPSMTQLLRR

SEQ ID NO: 43220 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKMGVSNKDIEKETAKDAGSEPPSMTQLLRR

SEQ ID NO: 43221 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKMGVSNKDIEKETAKDAGAEPPSMTQLLRR

SEQ ID NO: 43222 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKMGVSNKDIEKETAKDASGEPPSMTQLLRR

SEQ ID NO: 43223 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKMGVSNKDIEKETAKDASSEPPSMTQLLRR

SEQ ID NO: 43224 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKMGVSNKDIEKETAKDASAEPPSMTQLLRR

SEQ ID NO: 43225 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKMGVSNKDIEKETAKDAAGEPPSMTQLLRR

SEQ ID NO: 43226 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKMGVSNKDIEKETAKDAASEPPSMTQLLRR

SEQ ID NO: 43227 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKMGVSNKDIEKETAKDAAAEPPSMTQLLRR

SEQ ID NO: 43228 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKCGVSNKDIEKETAKDGGGEPPSMTQLLRR

SEQ ID NO: 43229 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKCGVSNKDIEKETAKDGGSEPPSMTQLLRR

SEQ ID NO: 43230 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKCGVSNKDIEKETAKDGGAEPPSMTQLLRR

SEQ ID NO: 43231 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKCGVSNKDIEKETAKDGSGEPPSMTQLLRR

SEQ ID NO: 43232 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKCGVSNKDIEKETAKDGSSEPPSMTQLLRR

SEQ ID NO: 43233 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKCGVSNKDIEKETAKDGSAEPPSMTQLLRR

SEQ ID NO: 43234 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKCGVSNKDIEKETAKDGAGEPPSMTQLLRR

SEQ ID NO: 43235 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKCGVSNKDIEKETAKDGASEPPSMTQLLRR

SEQ ID NO: 43236 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKCGVSNKDIEKETAKDGAAEPPSMTQLLRR

SEQ ID NO: 43237 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKCGVSNKDIEKETAKDSGGEPPSMTQLLRR

SEQ ID NO: 43238 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKCGVSNKDIEKETAKDSGSEPPSMTQLLRR

SEQ ID NO: 43239 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKCGVSNKDIEKETAKDSGAEPPSMTQLLRR

SEQ ID NO: 43240 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKCGVSNKDIEKETAKDSSGEPPSMTQLLRR

SEQ ID NO: 43241 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKCGVSNKDIEKETAKDSSSEPPSMTQLLRR

SEQ ID NO: 43242 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKCGVSNKDIEKETAKDSSAEPPSMTQLLRR

SEQ ID NO: 43243 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKCGVSNKDIEKETAKDSAGEPPSMTQLLRR

SEQ ID NO: 43244 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKCGVSNKDIEKETAKDSASEPPSMTQLLRR

SEQ ID NO: 43245 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKCGVSNKDIEKETAKDSAAEPPSMTQLLRR

SEQ ID NO: 43246 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKCGVSNKDIEKETAKDAGGEPPSMTQLLRR

SEQ ID NO: 43247 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKCGVSNKDIEKETAKDAGSEPPSMTQLLRR

SEQ ID NO: 43248 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKCGVSNKDIEKETAKDAGAEPPSMTQLLRR

SEQ ID NO: 43249 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKCGVSNKDIEKETAKDASGEPPSMTQLLRR

SEQ ID NO: 43250 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKCGVSNKDIEKETAKDASSEPPSMTQLLRR

SEQ ID NO: 43251 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKCGVSNKDIEKETAKDASAEPPSMTQLLRR

SEQ ID NO: 43252 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKCGVSNKDIEKETAKDAAGEPPSMTQLLRR

SEQ ID NO: 43253 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKCGVSNKDIEKETAKDAASEPPSMTQLLRR

SEQ ID NO: 43254 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKCGVSNKDIEKETAKDAAAEPPSMTQLLRR

SEQ ID NO: 43255 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKSGVSNKDIEKETAKDGGGEPPSMTQLLRR

SEQ ID NO: 43256 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKSGVSNKDIEKETAKDGGSEPPSMTQLLRR

SEQ ID NO: 43257 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKSGVSNKDIEKETAKDGGAEPPSMTQLLRR

SEQ ID NO: 43258 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKSGVSNKDIEKETAKDGSGEPPSMTQLLRR

SEQ ID NO: 43259 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKSGVSNKDIEKETAKDGSSEPPSMTQLLRR

SEQ ID NO: 43260 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKSGVSNKDIEKETAKDGSAEPPSMTQLLRR

SEQ ID NO: 43261 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKSGVSNKDIEKETAKDGAGEPPSMTQLLRR

SEQ ID NO: 43262 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKSGVSNKDIEKETAKDGASEPPSMTQLLRR

SEQ ID NO: 43263 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKSGVSNKDIEKETAKDGAAEPPSMTQLLRR

SEQ ID NO: 43264 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKSGVSNKDIEKETAKDSGGEPPSMTQLLRR

SEQ ID NO: 43265 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKSGVSNKDIEKETAKDSGSEPPSMTQLLRR

SEQ ID NO: 43266 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKSGVSNKDIEKETAKDSGAEPPSMTQLLRR

SEQ ID NO: 43267 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKSGVSNKDIEKETAKDSSGEPPSMTQLLRR

SEQ ID NO: 43268 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKSGVSNKDIEKETAKDSSSEPPSMTQLLRR

SEQ ID NO: 43269 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKSGVSNKDIEKETAKDSSAEPPSMTQLLRR

SEQ ID NO: 43270 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKSGVSNKDIEKETAKDSAGEPPSMTQLLRR

SEQ ID NO: 43271 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKSGVSNKDIEKETAKDSASEPPSMTQLLRR

SEQ ID NO: 43272 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKSGVSNKDIEKETAKDSAAEPPSMTQLLRR

SEQ ID NO: 43273 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKSGVSNKDIEKETAKDAGGEPPSMTQLLRR

SEQ ID NO: 43274 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKSGVSNKDIEKETAKDAGSEPPSMTQLLRR

SEQ ID NO: 43275 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKSGVSNKDIEKETAKDAGAEPPSMTQLLRR

SEQ ID NO: 43276 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKSGVSNKDIEKETAKDASGEPPSMTQLLRR

SEQ ID NO: 43277 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKSGVSNKDIEKETAKDASSEPPSMTQLLRR

SEQ ID NO: 43278 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKSGVSNKDIEKETAKDASAEPPSMTQLLRR

SEQ ID NO: 43279 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKSGVSNKDIEKETAKDAAGEPPSMTQLLRR

SEQ ID NO: 43280 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKSGVSNKDIEKETAKDAASEPPSMTQLLRR

SEQ ID NO: 43281 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKSGVSNKDIEKETAKDAAAEPPSMTQLLRR

SEQ ID NO: 43282 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKAGVSNKDIEKETAKDGGGEPPSMTQLLRR

SEQ ID NO: 43283 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKAGVSNKDIEKETAKDGGSEPPSMTQLLRR

SEQ ID NO: 43284 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKAGVSNKDIEKETAKDGGAEPPSMTQLLRR

SEQ ID NO: 43285 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKAGVSNKDIEKETAKDGSGEPPSMTQLLRR

SEQ ID NO: 43286 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKAGVSNKDIEKETAKDGSSEPPSMTQLLRR

SEQ ID NO: 43287 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKAGVSNKDIEKETAKDGSAEPPSMTQLLRR

SEQ ID NO: 43288 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKAGVSNKDIEKETAKDGAGEPPSMTQLLRR

SEQ ID NO: 43289 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKAGVSNKDIEKETAKDGASEPPSMTQLLRR

SEQ ID NO: 43290 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKAGVSNKDIEKETAKDGAAEPPSMTQLLRR

SEQ ID NO: 43291 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKAGVSNKDIEKETAKDSGGEPPSMTQLLRR

SEQ ID NO: 43292 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKAGVSNKDIEKETAKDSGSEPPSMTQLLRR

SEQ ID NO: 43293 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKAGVSNKDIEKETAKDSGAEPPSMTQLLRR

SEQ ID NO: 43294 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKAGVSNKDIEKETAKDSSGEPPSMTQLLRR

SEQ ID NO: 43295 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKAGVSNKDIEKETAKDSSSEPPSMTQLLRR

SEQ ID NO: 43296 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKAGVSNKDIEKETAKDSSAEPPSMTQLLRR

SEQ ID NO: 43297 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKAGVSNKDIEKETAKDSAGEPPSMTQLLRR

SEQ ID NO: 43298 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKAGVSNKDIEKETAKDSASEPPSMTQLLRR

SEQ ID NO: 43299 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKAGVSNKDIEKETAKDSAAEPPSMTQLLRR

SEQ ID NO: 43300 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKAGVSNKDIEKETAKDAGGEPPSMTQLLRR

SEQ ID NO: 43301 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKAGVSNKDIEKETAKDAGSEPPSMTQLLRR

SEQ ID NO: 43302 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKAGVSNKDIEKETAKDAGAEPPSMTQLLRR

SEQ ID NO: 43303 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKAGVSNKDIEKETAKDASGEPPSMTQLLRR

SEQ ID NO: 43304 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKAGVSNKDIEKETAKDASSEPPSMTQLLRR

SEQ ID NO: 43305 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKAGVSNKDIEKETAKDASAEPPSMTQLLRR

SEQ ID NO: 43306 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKAGVSNKDIEKETAKDAAGEPPSMTQLLRR

SEQ ID NO: 43307 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKAGVSNKDIEKETAKDAASEPPSMTQLLRR

SEQ ID NO: 43308 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKAGVSNKDIEKETAKDAAAEPPSMTQLLRR

SEQ ID NO: 43309 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKGGVSNKDIEKETAKDGGGEPPSMTQLLRR

SEQ ID NO: 43310 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKGGVSNKDIEKETAKDGGSEPPSMTQLLRR

SEQ ID NO: 43311 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKGGVSNKDIEKETAKDGGAEPPSMTQLLRR

SEQ ID NO: 43312 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKGGVSNKDIEKETAKDGSGEPPSMTQLLRR

SEQ ID NO: 43313 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKGGVSNKDIEKETAKDGSSEPPSMTQLLRR

SEQ ID NO: 43314 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKGGVSNKDIEKETAKDGSAEPPSMTQLLRR

SEQ ID NO: 43315 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKGGVSNKDIEKETAKDGAGEPPSMTQLLRR

SEQ ID NO: 43316 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKGGVSNKDIEKETAKDGASEPPSMTQLLRR

SEQ ID NO: 43317 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKGGVSNKDIEKETAKDGAAEPPSMTQLLRR

SEQ ID NO: 43318 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKGGVSNKDIEKETAKDSGGEPPSMTQLLRR

SEQ ID NO: 43319 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKGGVSNKDIEKETAKDSGSEPPSMTQLLRR

SEQ ID NO: 43320 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKGGVSNKDIEKETAKDSGAEPPSMTQLLRR

SEQ ID NO: 43321 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKGGVSNKDIEKETAKDSSGEPPSMTQLLRR

SEQ ID NO: 43322 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKGGVSNKDIEKETAKDSSSEPPSMTQLLRR

SEQ ID NO: 43323 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKGGVSNKDIEKETAKDSSAEPPSMTQLLRR

SEQ ID NO: 43324 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKGGVSNKDIEKETAKDSAGEPPSMTQLLRR

SEQ ID NO: 43325 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKGGVSNKDIEKETAKDSASEPPSMTQLLRR

SEQ ID NO: 43326 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKGGVSNKDIEKETAKDSAAEPPSMTQLLRR

SEQ ID NO: 43327 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKGGVSNKDIEKETAKDAGGEPPSMTQLLRR

SEQ ID NO: 43328 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKGGVSNKDIEKETAKDAGSEPPSMTQLLRR

SEQ ID NO: 43329 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKGGVSNKDIEKETAKDAGAEPPSMTQLLRR

SEQ ID NO: 43330 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKGGVSNKDIEKETAKDASGEPPSMTQLLRR

SEQ ID NO: 43331 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKGGVSNKDIEKETAKDASSEPPSMTQLLRR

SEQ ID NO: 43332 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKGGVSNKDIEKETAKDASAEPPSMTQLLRR

SEQ ID NO: 43333 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKGGVSNKDIEKETAKDAAGEPPSMTQLLRR

SEQ ID NO: 43334 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKGGVSNKDIEKETAKDAASEPPSMTQLLRR

SEQ ID NO: 43335 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKGGVSNKDIEKETAKDAAAEPPSMTQLLRR

SEQ ID NO: 43336 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKDGVSNKDIEKETAKDGGGEPPSMTQLLRR

SEQ ID NO: 43337 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKDGVSNKDIEKETAKDGGSEPPSMTQLLRR

SEQ ID NO: 43338 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKDGVSNKDIEKETAKDGGAEPPSMTQLLRR

SEQ ID NO: 43339 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKDGVSNKDIEKETAKDGSGEPPSMTQLLRR

SEQ ID NO: 43340 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKDGVSNKDIEKETAKDGSSEPPSMTQLLRR

SEQ ID NO: 43341 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKDGVSNKDIEKETAKDGSAEPPSMTQLLRR

SEQ ID NO: 43342 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKDGVSNKDIEKETAKDGAGEPPSMTQLLRR

SEQ ID NO: 43343 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKDGVSNKDIEKETAKDGASEPPSMTQLLRR

SEQ ID NO: 43344 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKDGVSNKDIEKETAKDGAAEPPSMTQLLRR

SEQ ID NO: 43345 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKDGVSNKDIEKETAKDSGGEPPSMTQLLRR

SEQ ID NO: 43346 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKDGVSNKDIEKETAKDSGSEPPSMTQLLRR

SEQ ID NO: 43347 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKDGVSNKDIEKETAKDSGAEPPSMTQLLRR

SEQ ID NO: 43348 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKDGVSNKDIEKETAKDSSGEPPSMTQLLRR

SEQ ID NO: 43349 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKDGVSNKDIEKETAKDSSSEPPSMTQLLRR

SEQ ID NO: 43350 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKDGVSNKDIEKETAKDSSAEPPSMTQLLRR

SEQ ID NO: 43351 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKDGVSNKDIEKETAKDSAGEPPSMTQLLRR

SEQ ID NO: 43352 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKDGVSNKDIEKETAKDSASEPPSMTQLLRR

SEQ ID NO: 43353 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKDGVSNKDIEKETAKDSAAEPPSMTQLLRR

SEQ ID NO: 43354 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKDGVSNKDIEKETAKDAGGEPPSMTQLLRR

SEQ ID NO: 43355 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKDGVSNKDIEKETAKDAGSEPPSMTQLLRR

SEQ ID NO: 43356 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKDGVSNKDIEKETAKDAGAEPPSMTQLLRR

SEQ ID NO: 43357 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKDGVSNKDIEKETAKDASGEPPSMTQLLRR

SEQ ID NO: 43358 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKDGVSNKDIEKETAKDASSEPPSMTQLLRR

SEQ ID NO: 43359 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKDGVSNKDIEKETAKDASAEPPSMTQLLRR

SEQ ID NO: 43360 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKDGVSNKDIEKETAKDAAGEPPSMTQLLRR

SEQ ID NO: 43361 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKDGVSNKDIEKETAKDAASEPPSMTQLLRR

SEQ ID NO: 43362 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKDGVSNKDIEKETAKDAAAEPPSMTQLLRR

SEQ ID NO: 43363 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKHGVSNKDIEKETAKDGGGEPPSMTQLLRR

SEQ ID NO: 43364 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKHGVSNKDIEKETAKDGGSEPPSMTQLLRR

SEQ ID NO: 43365 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKHGVSNKDIEKETAKDGGAEPPSMTQLLRR

SEQ ID NO: 43366 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKHGVSNKDIEKETAKDGSGEPPSMTQLLRR

SEQ ID NO: 43367 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKHGVSNKDIEKETAKDGSSEPPSMTQLLRR

SEQ ID NO: 43368 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKHGVSNKDIEKETAKDGSAEPPSMTQLLRR

SEQ ID NO: 43369 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKHGVSNKDIEKETAKDGAGEPPSMTQLLRR

SEQ ID NO: 43370 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKHGVSNKDIEKETAKDGASEPPSMTQLLRR

SEQ ID NO: 43371 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKHGVSNKDIEKETAKDGAAEPPSMTQLLRR

SEQ ID NO: 43372 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKHGVSNKDIEKETAKDSGGEPPSMTQLLRR

SEQ ID NO: 43373 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKHGVSNKDIEKETAKDSGSEPPSMTQLLRR

SEQ ID NO: 43374 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKHGVSNKDIEKETAKDSGAEPPSMTQLLRR

SEQ ID NO: 43375 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKHGVSNKDIEKETAKDSSGEPPSMTQLLRR

SEQ ID NO: 43376 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKHGVSNKDIEKETAKDSSSEPPSMTQLLRR

SEQ ID NO: 43377 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKHGVSNKDIEKETAKDSSAEPPSMTQLLRR

SEQ ID NO: 43378 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKHGVSNKDIEKETAKDSAGEPPSMTQLLRR

SEQ ID NO: 43379 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKHGVSNKDIEKETAKDSASEPPSMTQLLRR

SEQ ID NO: 43380 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKHGVSNKDIEKETAKDSAAEPPSMTQLLRR

SEQ ID NO: 43381 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKHGVSNKDIEKETAKDAGGEPPSMTQLLRR

SEQ ID NO: 43382 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKHGVSNKDIEKETAKDAGSEPPSMTQLLRR

SEQ ID NO: 43383 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKHGVSNKDIEKETAKDAGAEPPSMTQLLRR

SEQ ID NO: 43384 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKHGVSNKDIEKETAKDASGEPPSMTQLLRR

SEQ ID NO: 43385 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKHGVSNKDIEKETAKDASSEPPSMTQLLRR

SEQ ID NO: 43386 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKHGVSNKDIEKETAKDASAEPPSMTQLLRR

SEQ ID NO: 43387 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKHGVSNKDIEKETAKDAAGEPPSMTQLLRR

SEQ ID NO: 43388 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKHGVSNKDIEKETAKDAASEPPSMTQLLRR

SEQ ID NO: 43389 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKHGVSNKDIEKETAKDAAAEPPSMTQLLRR

SEQ ID NO: 43390 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKYGVSNKDIEKETAKDGGGEPPSMTQLLRR

SEQ ID NO: 43391 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKYGVSNKDIEKETAKDGGSEPPSMTQLLRR

SEQ ID NO: 43392 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKYGVSNKDIEKETAKDGGAEPPSMTQLLRR

SEQ ID NO: 43393 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKYGVSNKDIEKETAKDGSGEPPSMTQLLRR

SEQ ID NO: 43394 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKYGVSNKDIEKETAKDGSSEPPSMTQLLRR

SEQ ID NO: 43395 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKYGVSNKDIEKETAKDGSAEPPSMTQLLRR

SEQ ID NO: 43396 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKYGVSNKDIEKETAKDGAGEPPSMTQLLRR

SEQ ID NO: 43397 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKYGVSNKDIEKETAKDGASEPPSMTQLLRR

SEQ ID NO: 43398 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKYGVSNKDIEKETAKDGAAEPPSMTQLLRR

SEQ ID NO: 43399 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKYGVSNKDIEKETAKDSGGEPPSMTQLLRR

SEQ ID NO: 43400 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKYGVSNKDIEKETAKDSGSEPPSMTQLLRR

SEQ ID NO: 43401 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKYGVSNKDIEKETAKDSGAEPPSMTQLLRR

SEQ ID NO: 43402 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKYGVSNKDIEKETAKDSSGEPPSMTQLLRR

SEQ ID NO: 43403 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKYGVSNKDIEKETAKDSSSEPPSMTQLLRR

SEQ ID NO: 43404 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKYGVSNKDIEKETAKDSSAEPPSMTQLLRR

SEQ ID NO: 43405 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKYGVSNKDIEKETAKDSAGEPPSMTQLLRR

SEQ ID NO: 43406 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKYGVSNKDIEKETAKDSASEPPSMTQLLRR

SEQ ID NO: 43407 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKYGVSNKDIEKETAKDSAAEPPSMTQLLRR

SEQ ID NO: 43408 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKYGVSNKDIEKETAKDAGGEPPSMTQLLRR

SEQ ID NO: 43409 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKYGVSNKDIEKETAKDAGSEPPSMTQLLRR

SEQ ID NO: 43410 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKYGVSNKDIEKETAKDAGAEPPSMTQLLRR

SEQ ID NO: 43411 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKYGVSNKDIEKETAKDASGEPPSMTQLLRR

SEQ ID NO: 43412 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKYGVSNKDIEKETAKDASSEPPSMTQLLRR

SEQ ID NO: 43413 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKYGVSNKDIEKETAKDASAEPPSMTQLLRR

SEQ ID NO: 43414 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKYGVSNKDIEKETAKDAAGEPPSMTQLLRR

SEQ ID NO: 43415 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKYGVSNKDIEKETAKDAASEPPSMTQLLRR

SEQ ID NO: 43416 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKYGVSNKDIEKETAKDAAAEPPSMTQLLRR

SEQ ID NO: 43417 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKKGVSNKDIEKETAKDGGGEPPSMTQLLRR

SEQ ID NO: 43418 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKKGVSNKDIEKETAKDGGSEPPSMTQLLRR

SEQ ID NO: 43419 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKKGVSNKDIEKETAKDGGAEPPSMTQLLRR

SEQ ID NO: 43420 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKKGVSNKDIEKETAKDGSGEPPSMTQLLRR

SEQ ID NO: 43421 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKKGVSNKDIEKETAKDGSSEPPSMTQLLRR

SEQ ID NO: 43422 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKKGVSNKDIEKETAKDGSAEPPSMTQLLRR

SEQ ID NO: 43423 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKKGVSNKDIEKETAKDGAGEPPSMTQLLRR

SEQ ID NO: 43424 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKKGVSNKDIEKETAKDGASEPPSMTQLLRR

SEQ ID NO: 43425 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKKGVSNKDIEKETAKDGAAEPPSMTQLLRR

SEQ ID NO: 43426 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKKGVSNKDIEKETAKDSGGEPPSMTQLLRR

SEQ ID NO: 43427 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKKGVSNKDIEKETAKDSGSEPPSMTQLLRR

SEQ ID NO: 43428 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKKGVSNKDIEKETAKDSGAEPPSMTQLLRR

SEQ ID NO: 43429 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKKGVSNKDIEKETAKDSSGEPPSMTQLLRR

SEQ ID NO: 43430 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKKGVSNKDIEKETAKDSSSEPPSMTQLLRR

SEQ ID NO: 43431 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKKGVSNKDIEKETAKDSSAEPPSMTQLLRR

SEQ ID NO: 43432 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKKGVSNKDIEKETAKDSAGEPPSMTQLLRR

SEQ ID NO: 43433 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKKGVSNKDIEKETAKDSASEPPSMTQLLRR

SEQ ID NO: 43434 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKKGVSNKDIEKETAKDSAAEPPSMTQLLRR

SEQ ID NO: 43435 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKKGVSNKDIEKETAKDAGGEPPSMTQLLRR

SEQ ID NO: 43436 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKKGVSNKDIEKETAKDAGSEPPSMTQLLRR

SEQ ID NO: 43437 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKKGVSNKDIEKETAKDAGAEPPSMTQLLRR

SEQ ID NO: 43438 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKKGVSNKDIEKETAKDASGEPPSMTQLLRR

SEQ ID NO: 43439 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKKGVSNKDIEKETAKDASSEPPSMTQLLRR

SEQ ID NO: 43440 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKKGVSNKDIEKETAKDASAEPPSMTQLLRR

SEQ ID NO: 43441 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKKGVSNKDIEKETAKDAAGEPPSMTQLLRR

SEQ ID NO: 43442 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKKGVSNKDIEKETAKDAASEPPSMTQLLRR

SEQ ID NO: 43443 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKKGVSNKDIEKETAKDAAAEPPSMTQLLRR

SEQ ID NO: 43444 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKNGVSNKDIEKETAKDGGGEPPSMTQLLRR

SEQ ID NO: 43445 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKNGVSNKDIEKETAKDGGSEPPSMTQLLRR

SEQ ID NO: 43446 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKNGVSNKDIEKETAKDGGAEPPSMTQLLRR

SEQ ID NO: 43447 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKNGVSNKDIEKETAKDGSGEPPSMTQLLRR

SEQ ID NO: 43448 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKNGVSNKDIEKETAKDGSSEPPSMTQLLRR

SEQ ID NO: 43449 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKNGVSNKDIEKETAKDGSAEPPSMTQLLRR

SEQ ID NO: 43450 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKNGVSNKDIEKETAKDGAGEPPSMTQLLRR

SEQ ID NO: 43451 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKNGVSNKDIEKETAKDGASEPPSMTQLLRR

SEQ ID NO: 43452 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKNGVSNKDIEKETAKDGAAEPPSMTQLLRR

SEQ ID NO: 43453 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKNGVSNKDIEKETAKDSGGEPPSMTQLLRR

SEQ ID NO: 43454 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKNGVSNKDIEKETAKDSGSEPPSMTQLLRR

SEQ ID NO: 43455 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKNGVSNKDIEKETAKDSGAEPPSMTQLLRR

SEQ ID NO: 43456 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKNGVSNKDIEKETAKDSSGEPPSMTQLLRR

SEQ ID NO: 43457 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKNGVSNKDIEKETAKDSSSEPPSMTQLLRR

SEQ ID NO: 43458 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKNGVSNKDIEKETAKDSSAEPPSMTQLLRR

SEQ ID NO: 43459 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKNGVSNKDIEKETAKDSAGEPPSMTQLLRR

SEQ ID NO: 43460 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKNGVSNKDIEKETAKDSASEPPSMTQLLRR

SEQ ID NO: 43461 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKNGVSNKDIEKETAKDSAAEPPSMTQLLRR

SEQ ID NO: 43462 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKNGVSNKDIEKETAKDAGGEPPSMTQLLRR

SEQ ID NO: 43463 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKNGVSNKDIEKETAKDAGSEPPSMTQLLRR

SEQ ID NO: 43464 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKNGVSNKDIEKETAKDAGAEPPSMTQLLRR

SEQ ID NO: 43465 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKNGVSNKDIEKETAKDASGEPPSMTQLLRR

SEQ ID NO: 43466 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKNGVSNKDIEKETAKDASSEPPSMTQLLRR

SEQ ID NO: 43467 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKNGVSNKDIEKETAKDASAEPPSMTQLLRR

SEQ ID NO: 43468 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKNGVSNKDIEKETAKDAAGEPPSMTQLLRR

SEQ ID NO: 43469 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKNGVSNKDIEKETAKDAASEPPSMTQLLRR

SEQ ID NO: 43470 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKNGVSNKDIEKETAKDAAAEPPSMTQLLRR

SEQ ID NO: 43471 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKMGVSNKDIEKETAKDGGGEPPSMTQLLRR

SEQ ID NO: 43472 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKMGVSNKDIEKETAKDGGSEPPSMTQLLRR

SEQ ID NO: 43473 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKMGVSNKDIEKETAKDGGAEPPSMTQLLRR

SEQ ID NO: 43474 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKMGVSNKDIEKETAKDGSGEPPSMTQLLRR

SEQ ID NO: 43475 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKMGVSNKDIEKETAKDGSSEPPSMTQLLRR

SEQ ID NO: 43476 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKMGVSNKDIEKETAKDGSAEPPSMTQLLRR

SEQ ID NO: 43477 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKMGVSNKDIEKETAKDGAGEPPSMTQLLRR

SEQ ID NO: 43478 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKMGVSNKDIEKETAKDGASEPPSMTQLLRR

SEQ ID NO: 43479 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKMGVSNKDIEKETAKDGAAEPPSMTQLLRR

SEQ ID NO: 43480 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKMGVSNKDIEKETAKDSGGEPPSMTQLLRR

SEQ ID NO: 43481 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKMGVSNKDIEKETAKDSGSEPPSMTQLLRR

SEQ ID NO: 43482 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKMGVSNKDIEKETAKDSGAEPPSMTQLLRR

SEQ ID NO: 43483 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKMGVSNKDIEKETAKDSSGEPPSMTQLLRR

SEQ ID NO: 43484 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKMGVSNKDIEKETAKDSSSEPPSMTQLLRR

SEQ ID NO: 43485 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKMGVSNKDIEKETAKDSSAEPPSMTQLLRR

SEQ ID NO: 43486 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKMGVSNKDIEKETAKDSAGEPPSMTQLLRR

SEQ ID NO: 43487 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKMGVSNKDIEKETAKDSASEPPSMTQLLRR

SEQ ID NO: 43488 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKMGVSNKDIEKETAKDSAAEPPSMTQLLRR

SEQ ID NO: 43489 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKMGVSNKDIEKETAKDAGGEPPSMTQLLRR

SEQ ID NO: 43490 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKMGVSNKDIEKETAKDAGSEPPSMTQLLRR

SEQ ID NO: 43491 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKMGVSNKDIEKETAKDAGAEPPSMTQLLRR

SEQ ID NO: 43492 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKMGVSNKDIEKETAKDASGEPPSMTQLLRR

SEQ ID NO: 43493 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKMGVSNKDIEKETAKDASSEPPSMTQLLRR

SEQ ID NO: 43494 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKMGVSNKDIEKETAKDASAEPPSMTQLLRR

SEQ ID NO: 43495 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKMGVSNKDIEKETAKDAAGEPPSMTQLLRR

SEQ ID NO: 43496 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKMGVSNKDIEKETAKDAASEPPSMTQLLRR

SEQ ID NO: 43497 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKMGVSNKDIEKETAKDAAAEPPSMTQLLRR

SEQ ID NO: 43498 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKCGVSNKDIEKETAKDGGGEPPSMTQLLRR

SEQ ID NO: 43499 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKCGVSNKDIEKETAKDGGSEPPSMTQLLRR

SEQ ID NO: 43500 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKCGVSNKDIEKETAKDGGAEPPSMTQLLRR

SEQ ID NO: 43501 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKCGVSNKDIEKETAKDGSGEPPSMTQLLRR

SEQ ID NO: 43502 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKCGVSNKDIEKETAKDGSSEPPSMTQLLRR

SEQ ID NO: 43503 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKCGVSNKDIEKETAKDGSAEPPSMTQLLRR

SEQ ID NO: 43504 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKCGVSNKDIEKETAKDGAGEPPSMTQLLRR

SEQ ID NO: 43505 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKCGVSNKDIEKETAKDGASEPPSMTQLLRR

SEQ ID NO: 43506 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKCGVSNKDIEKETAKDGAAEPPSMTQLLRR

SEQ ID NO: 43507 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKCGVSNKDIEKETAKDSGGEPPSMTQLLRR

SEQ ID NO: 43508 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKCGVSNKDIEKETAKDSGSEPPSMTQLLRR

SEQ ID NO: 43509 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKCGVSNKDIEKETAKDSGAEPPSMTQLLRR

SEQ ID NO: 43510 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKCGVSNKDIEKETAKDSSGEPPSMTQLLRR

SEQ ID NO: 43511 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKCGVSNKDIEKETAKDSSSEPPSMTQLLRR

SEQ ID NO: 43512 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKCGVSNKDIEKETAKDSSAEPPSMTQLLRR

SEQ ID NO: 43513 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKCGVSNKDIEKETAKDSAGEPPSMTQLLRR

SEQ ID NO: 43514 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKCGVSNKDIEKETAKDSASEPPSMTQLLRR

SEQ ID NO: 43515 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKCGVSNKDIEKETAKDSAAEPPSMTQLLRR

SEQ ID NO: 43516 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKCGVSNKDIEKETAKDAGGEPPSMTQLLRR

SEQ ID NO: 43517 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKCGVSNKDIEKETAKDAGSEPPSMTQLLRR

SEQ ID NO: 43518 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKCGVSNKDIEKETAKDAGAEPPSMTQLLRR

SEQ ID NO: 43519 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKCGVSNKDIEKETAKDASGEPPSMTQLLRR

SEQ ID NO: 43520 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKCGVSNKDIEKETAKDASSEPPSMTQLLRR

SEQ ID NO: 43521 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKCGVSNKDIEKETAKDASAEPPSMTQLLRR

SEQ ID NO: 43522 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKCGVSNKDIEKETAKDAAGEPPSMTQLLRR

SEQ ID NO: 43523 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKCGVSNKDIEKETAKDAASEPPSMTQLLRR

SEQ ID NO: 43524 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKCGVSNKDIEKETAKDAAAEPPSMTQLLRR

SEQ ID NO: 43525 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKSGVSNKDIEKETAKDGGGEPPSMTQLLRR

SEQ ID NO: 43526 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKSGVSNKDIEKETAKDGGSEPPSMTQLLRR

SEQ ID NO: 43527 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKSGVSNKDIEKETAKDGGAEPPSMTQLLRR

SEQ ID NO: 43528 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKSGVSNKDIEKETAKDGSGEPPSMTQLLRR

SEQ ID NO: 43529 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKSGVSNKDIEKETAKDGSSEPPSMTQLLRR

SEQ ID NO: 43530 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKSGVSNKDIEKETAKDGSAEPPSMTQLLRR

SEQ ID NO: 43531 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKSGVSNKDIEKETAKDGAGEPPSMTQLLRR

SEQ ID NO: 43532 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKSGVSNKDIEKETAKDGASEPPSMTQLLRR

SEQ ID NO: 43533 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKSGVSNKDIEKETAKDGAAEPPSMTQLLRR

SEQ ID NO: 43534 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKSGVSNKDIEKETAKDSGGEPPSMTQLLRR

SEQ ID NO: 43535 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKSGVSNKDIEKETAKDSGSEPPSMTQLLRR

SEQ ID NO: 43536 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKSGVSNKDIEKETAKDSGAEPPSMTQLLRR

SEQ ID NO: 43537 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKSGVSNKDIEKETAKDSSGEPPSMTQLLRR

SEQ ID NO: 43538 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKSGVSNKDIEKETAKDSSSEPPSMTQLLRR

SEQ ID NO: 43539 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKSGVSNKDIEKETAKDSSAEPPSMTQLLRR

SEQ ID NO: 43540 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKSGVSNKDIEKETAKDSAGEPPSMTQLLRR

SEQ ID NO: 43541 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKSGVSNKDIEKETAKDSASEPPSMTQLLRR

SEQ ID NO: 43542 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKSGVSNKDIEKETAKDSAAEPPSMTQLLRR

SEQ ID NO: 43543 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKSGVSNKDIEKETAKDAGGEPPSMTQLLRR

SEQ ID NO: 43544 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKSGVSNKDIEKETAKDAGSEPPSMTQLLRR

SEQ ID NO: 43545 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKSGVSNKDIEKETAKDAGAEPPSMTQLLRR

SEQ ID NO: 43546 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKSGVSNKDIEKETAKDASGEPPSMTQLLRR

SEQ ID NO: 43547 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKSGVSNKDIEKETAKDASSEPPSMTQLLRR

SEQ ID NO: 43548 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKSGVSNKDIEKETAKDASAEPPSMTQLLRR

SEQ ID NO: 43549 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKSGVSNKDIEKETAKDAAGEPPSMTQLLRR

SEQ ID NO: 43550 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKSGVSNKDIEKETAKDAASEPPSMTQLLRR

SEQ ID NO: 43551 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKSGVSNKDIEKETAKDAAAEPPSMTQLLRR

SEQ ID NO: 43552 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKAGVSNKDIEKETAKDGGGEPPSMTQLLRR

SEQ ID NO: 43553 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKAGVSNKDIEKETAKDGGSEPPSMTQLLRR

SEQ ID NO: 43554 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKAGVSNKDIEKETAKDGGAEPPSMTQLLRR

SEQ ID NO: 43555 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKAGVSNKDIEKETAKDGSGEPPSMTQLLRR

SEQ ID NO: 43556 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKAGVSNKDIEKETAKDGSSEPPSMTQLLRR

SEQ ID NO: 43557 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKAGVSNKDIEKETAKDGSAEPPSMTQLLRR

SEQ ID NO: 43558 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKAGVSNKDIEKETAKDGAGEPPSMTQLLRR

SEQ ID NO: 43559 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKAGVSNKDIEKETAKDGASEPPSMTQLLRR

SEQ ID NO: 43560 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKAGVSNKDIEKETAKDGAAEPPSMTQLLRR

SEQ ID NO: 43561 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKAGVSNKDIEKETAKDSGGEPPSMTQLLRR

SEQ ID NO: 43562 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKAGVSNKDIEKETAKDSGSEPPSMTQLLRR

SEQ ID NO: 43563 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKAGVSNKDIEKETAKDSGAEPPSMTQLLRR

SEQ ID NO: 43564 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKAGVSNKDIEKETAKDSSGEPPSMTQLLRR

SEQ ID NO: 43565 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKAGVSNKDIEKETAKDSSSEPPSMTQLLRR

SEQ ID NO: 43566 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKAGVSNKDIEKETAKDSSAEPPSMTQLLRR

SEQ ID NO: 43567 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKAGVSNKDIEKETAKDSAGEPPSMTQLLRR

SEQ ID NO: 43568 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKAGVSNKDIEKETAKDSASEPPSMTQLLRR

SEQ ID NO: 43569 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKAGVSNKDIEKETAKDSAAEPPSMTQLLRR

SEQ ID NO: 43570 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKAGVSNKDIEKETAKDAGGEPPSMTQLLRR

SEQ ID NO: 43571 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKAGVSNKDIEKETAKDAGSEPPSMTQLLRR

SEQ ID NO: 43572 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKAGVSNKDIEKETAKDAGAEPPSMTQLLRR

SEQ ID NO: 43573 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKAGVSNKDIEKETAKDASGEPPSMTQLLRR

SEQ ID NO: 43574 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKAGVSNKDIEKETAKDASSEPPSMTQLLRR

SEQ ID NO: 43575 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKAGVSNKDIEKETAKDASAEPPSMTQLLRR

SEQ ID NO: 43576 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKAGVSNKDIEKETAKDAAGEPPSMTQLLRR

SEQ ID NO: 43577 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKAGVSNKDIEKETAKDAASEPPSMTQLLRR

SEQ ID NO: 43578 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKAGVSNKDIEKETAKDAAAEPPSMTQLLRR

SEQ ID NO: 43579 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKGGVSNKDIEKETAKDGGGEPPSMTQLLRR

SEQ ID NO: 43580 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKGGVSNKDIEKETAKDGGSEPPSMTQLLRR

SEQ ID NO: 43581 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKGGVSNKDIEKETAKDGGAEPPSMTQLLRR

SEQ ID NO: 43582 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKGGVSNKDIEKETAKDGSGEPPSMTQLLRR

SEQ ID NO: 43583 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKGGVSNKDIEKETAKDGSSEPPSMTQLLRR

SEQ ID NO: 43584 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKGGVSNKDIEKETAKDGSAEPPSMTQLLRR

SEQ ID NO: 43585 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKGGVSNKDIEKETAKDGAGEPPSMTQLLRR

SEQ ID NO: 43586 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKGGVSNKDIEKETAKDGASEPPSMTQLLRR

SEQ ID NO: 43587 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKGGVSNKDIEKETAKDGAAEPPSMTQLLRR

SEQ ID NO: 43588 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKGGVSNKDIEKETAKDSGGEPPSMTQLLRR

SEQ ID NO: 43589 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKGGVSNKDIEKETAKDSGSEPPSMTQLLRR

SEQ ID NO: 43590 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKGGVSNKDIEKETAKDSGAEPPSMTQLLRR

SEQ ID NO: 43591 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKGGVSNKDIEKETAKDSSGEPPSMTQLLRR

SEQ ID NO: 43592 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKGGVSNKDIEKETAKDSSSEPPSMTQLLRR

SEQ ID NO: 43593 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKGGVSNKDIEKETAKDSSAEPPSMTQLLRR

SEQ ID NO: 43594 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKGGVSNKDIEKETAKDSAGEPPSMTQLLRR

SEQ ID NO: 43595 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKGGVSNKDIEKETAKDSASEPPSMTQLLRR

SEQ ID NO: 43596 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKGGVSNKDIEKETAKDSAAEPPSMTQLLRR

SEQ ID NO: 43597 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKGGVSNKDIEKETAKDAGGEPPSMTQLLRR

SEQ ID NO: 43598 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKGGVSNKDIEKETAKDAGSEPPSMTQLLRR

SEQ ID NO: 43599 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKGGVSNKDIEKETAKDAGAEPPSMTQLLRR

SEQ ID NO: 43600 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKGGVSNKDIEKETAKDASGEPPSMTQLLRR

SEQ ID NO: 43601 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKGGVSNKDIEKETAKDASSEPPSMTQLLRR

SEQ ID NO: 43602 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKGGVSNKDIEKETAKDASAEPPSMTQLLRR

SEQ ID NO: 43603 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKGGVSNKDIEKETAKDAAGEPPSMTQLLRR

SEQ ID NO: 43604 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKGGVSNKDIEKETAKDAASEPPSMTQLLRR

SEQ ID NO: 43605 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKGGVSNKDIEKETAKDAAAEPPSMTQLLRR

SEQ ID NO: 43606 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKDGVSNKDIEKETAKDGGGEPPSMTQLLRR

SEQ ID NO: 43607 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKDGVSNKDIEKETAKDGGSEPPSMTQLLRR

SEQ ID NO: 43608 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKDGVSNKDIEKETAKDGGAEPPSMTQLLRR

SEQ ID NO: 43609 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKDGVSNKDIEKETAKDGSGEPPSMTQLLRR

SEQ ID NO: 43610 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKDGVSNKDIEKETAKDGSSEPPSMTQLLRR

SEQ ID NO: 43611 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKDGVSNKDIEKETAKDGSAEPPSMTQLLRR

SEQ ID NO: 43612 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKDGVSNKDIEKETAKDGAGEPPSMTQLLRR

SEQ ID NO: 43613 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKDGVSNKDIEKETAKDGASEPPSMTQLLRR

SEQ ID NO: 43614 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKDGVSNKDIEKETAKDGAAEPPSMTQLLRR

SEQ ID NO: 43615 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKDGVSNKDIEKETAKDSGGEPPSMTQLLRR

SEQ ID NO: 43616 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKDGVSNKDIEKETAKDSGSEPPSMTQLLRR

SEQ ID NO: 43617 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKDGVSNKDIEKETAKDSGAEPPSMTQLLRR

SEQ ID NO: 43618 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKDGVSNKDIEKETAKDSSGEPPSMTQLLRR

SEQ ID NO: 43619 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKDGVSNKDIEKETAKDSSSEPPSMTQLLRR

SEQ ID NO: 43620 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKDGVSNKDIEKETAKDSSAEPPSMTQLLRR

SEQ ID NO: 43621 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKDGVSNKDIEKETAKDSAGEPPSMTQLLRR

SEQ ID NO: 43622 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKDGVSNKDIEKETAKDSASEPPSMTQLLRR

SEQ ID NO: 43623 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKDGVSNKDIEKETAKDSAAEPPSMTQLLRR

SEQ ID NO: 43624 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKDGVSNKDIEKETAKDAGGEPPSMTQLLRR

SEQ ID NO: 43625 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKDGVSNKDIEKETAKDAGSEPPSMTQLLRR

SEQ ID NO: 43626 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKDGVSNKDIEKETAKDAGAEPPSMTQLLRR

SEQ ID NO: 43627 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKDGVSNKDIEKETAKDASGEPPSMTQLLRR

SEQ ID NO: 43628 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKDGVSNKDIEKETAKDASSEPPSMTQLLRR

SEQ ID NO: 43629 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKDGVSNKDIEKETAKDASAEPPSMTQLLRR

SEQ ID NO: 43630 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKDGVSNKDIEKETAKDAAGEPPSMTQLLRR

SEQ ID NO: 43631 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKDGVSNKDIEKETAKDAASEPPSMTQLLRR

SEQ ID NO: 43632 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKDGVSNKDIEKETAKDAAAEPPSMTQLLRR

SEQ ID NO: 43633 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKHGVSNKDIEKETAKDGGGEPPSMTQLLRR

SEQ ID NO: 43634 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKHGVSNKDIEKETAKDGGSEPPSMTQLLRR

SEQ ID NO: 43635 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKHGVSNKDIEKETAKDGGAEPPSMTQLLRR

SEQ ID NO: 43636 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKHGVSNKDIEKETAKDGSGEPPSMTQLLRR

SEQ ID NO: 43637 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKHGVSNKDIEKETAKDGSSEPPSMTQLLRR

SEQ ID NO: 43638 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKHGVSNKDIEKETAKDGSAEPPSMTQLLRR

SEQ ID NO: 43639 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKHGVSNKDIEKETAKDGAGEPPSMTQLLRR

SEQ ID NO: 43640 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKHGVSNKDIEKETAKDGASEPPSMTQLLRR

SEQ ID NO: 43641 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKHGVSNKDIEKETAKDGAAEPPSMTQLLRR

SEQ ID NO: 43642 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKHGVSNKDIEKETAKDSGGEPPSMTQLLRR

SEQ ID NO: 43643 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKHGVSNKDIEKETAKDSGSEPPSMTQLLRR

SEQ ID NO: 43644 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKHGVSNKDIEKETAKDSGAEPPSMTQLLRR

SEQ ID NO: 43645 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKHGVSNKDIEKETAKDSSGEPPSMTQLLRR

SEQ ID NO: 43646 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKHGVSNKDIEKETAKDSSSEPPSMTQLLRR

SEQ ID NO: 43647 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKHGVSNKDIEKETAKDSSAEPPSMTQLLRR

SEQ ID NO: 43648 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKHGVSNKDIEKETAKDSAGEPPSMTQLLRR

SEQ ID NO: 43649 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKHGVSNKDIEKETAKDSASEPPSMTQLLRR

SEQ ID NO: 43650 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKHGVSNKDIEKETAKDSAAEPPSMTQLLRR

SEQ ID NO: 43651 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKHGVSNKDIEKETAKDAGGEPPSMTQLLRR

SEQ ID NO: 43652 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKHGVSNKDIEKETAKDAGSEPPSMTQLLRR

SEQ ID NO: 43653 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKHGVSNKDIEKETAKDAGAEPPSMTQLLRR

SEQ ID NO: 43654 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKHGVSNKDIEKETAKDASGEPPSMTQLLRR

SEQ ID NO: 43655 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKHGVSNKDIEKETAKDASSEPPSMTQLLRR

SEQ ID NO: 43656 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKHGVSNKDIEKETAKDASAEPPSMTQLLRR

SEQ ID NO: 43657 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKHGVSNKDIEKETAKDAAGEPPSMTQLLRR

SEQ ID NO: 43658 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKHGVSNKDIEKETAKDAASEPPSMTQLLRR

SEQ ID NO: 43659 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKHGVSNKDIEKETAKDAAAEPPSMTQLLRR

SEQ ID NO: 43660 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKYGVSNKDIEKETAKDGGGEPPSMTQLLRR

SEQ ID NO: 43661 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKYGVSNKDIEKETAKDGGSEPPSMTQLLRR

SEQ ID NO: 43662 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKYGVSNKDIEKETAKDGGAEPPSMTQLLRR

SEQ ID NO: 43663 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKYGVSNKDIEKETAKDGSGEPPSMTQLLRR

SEQ ID NO: 43664 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKYGVSNKDIEKETAKDGSSEPPSMTQLLRR

SEQ ID NO: 43665 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKYGVSNKDIEKETAKDGSAEPPSMTQLLRR

SEQ ID NO: 43666 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKYGVSNKDIEKETAKDGAGEPPSMTQLLRR

SEQ ID NO: 43667 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKYGVSNKDIEKETAKDGASEPPSMTQLLRR

SEQ ID NO: 43668 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKYGVSNKDIEKETAKDGAAEPPSMTQLLRR

SEQ ID NO: 43669 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKYGVSNKDIEKETAKDSGGEPPSMTQLLRR

SEQ ID NO: 43670 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKYGVSNKDIEKETAKDSGSEPPSMTQLLRR

SEQ ID NO: 43671 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKYGVSNKDIEKETAKDSGAEPPSMTQLLRR

SEQ ID NO: 43672 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKYGVSNKDIEKETAKDSSGEPPSMTQLLRR

SEQ ID NO: 43673 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKYGVSNKDIEKETAKDSSSEPPSMTQLLRR

SEQ ID NO: 43674 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKYGVSNKDIEKETAKDSSAEPPSMTQLLRR

SEQ ID NO: 43675 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKYGVSNKDIEKETAKDSAGEPPSMTQLLRR

SEQ ID NO: 43676 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKYGVSNKDIEKETAKDSASEPPSMTQLLRR

SEQ ID NO: 43677 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKYGVSNKDIEKETAKDSAAEPPSMTQLLRR

SEQ ID NO: 43678 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKYGVSNKDIEKETAKDAGGEPPSMTQLLRR

SEQ ID NO: 43679 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKYGVSNKDIEKETAKDAGSEPPSMTQLLRR

SEQ ID NO: 43680 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKYGVSNKDIEKETAKDAGAEPPSMTQLLRR

SEQ ID NO: 43681 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKYGVSNKDIEKETAKDASGEPPSMTQLLRR

SEQ ID NO: 43682 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKYGVSNKDIEKETAKDASSEPPSMTQLLRR

SEQ ID NO: 43683 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKYGVSNKDIEKETAKDASAEPPSMTQLLRR

SEQ ID NO: 43684 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKYGVSNKDIEKETAKDAAGEPPSMTQLLRR

SEQ ID NO: 43685 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKYGVSNKDIEKETAKDAASEPPSMTQLLRR

SEQ ID NO: 43686 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKYGVSNKDIEKETAKDAAAEPPSMTQLLRR

SEQ ID NO: 43687 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKKGVSNKDIEKETAKDGGGEPPSMTQLLRR

SEQ ID NO: 43688 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKKGVSNKDIEKETAKDGGSEPPSMTQLLRR

SEQ ID NO: 43689 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKKGVSNKDIEKETAKDGGAEPPSMTQLLRR

SEQ ID NO: 43690 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKKGVSNKDIEKETAKDGSGEPPSMTQLLRR

SEQ ID NO: 43691 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKKGVSNKDIEKETAKDGSSEPPSMTQLLRR

SEQ ID NO: 43692 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKKGVSNKDIEKETAKDGSAEPPSMTQLLRR

SEQ ID NO: 43693 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKKGVSNKDIEKETAKDGAGEPPSMTQLLRR

SEQ ID NO: 43694 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKKGVSNKDIEKETAKDGASEPPSMTQLLRR

SEQ ID NO: 43695 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKKGVSNKDIEKETAKDGAAEPPSMTQLLRR

SEQ ID NO: 43696 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKKGVSNKDIEKETAKDSGGEPPSMTQLLRR

SEQ ID NO: 43697 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKKGVSNKDIEKETAKDSGSEPPSMTQLLRR

SEQ ID NO: 43698 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKKGVSNKDIEKETAKDSGAEPPSMTQLLRR

SEQ ID NO: 43699 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKKGVSNKDIEKETAKDSSGEPPSMTQLLRR

SEQ ID NO: 43700 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKKGVSNKDIEKETAKDSSSEPPSMTQLLRR

SEQ ID NO: 43701 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKKGVSNKDIEKETAKDSSAEPPSMTQLLRR

SEQ ID NO: 43702 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKKGVSNKDIEKETAKDSAGEPPSMTQLLRR

SEQ ID NO: 43703 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKKGVSNKDIEKETAKDSASEPPSMTQLLRR

SEQ ID NO: 43704 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKKGVSNKDIEKETAKDSAAEPPSMTQLLRR

SEQ ID NO: 43705 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKKGVSNKDIEKETAKDAGGEPPSMTQLLRR

SEQ ID NO: 43706 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKKGVSNKDIEKETAKDAGSEPPSMTQLLRR

SEQ ID NO: 43707 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKKGVSNKDIEKETAKDAGAEPPSMTQLLRR

SEQ ID NO: 43708 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKKGVSNKDIEKETAKDASGEPPSMTQLLRR

SEQ ID NO: 43709 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKKGVSNKDIEKETAKDASSEPPSMTQLLRR

SEQ ID NO: 43710 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKKGVSNKDIEKETAKDASAEPPSMTQLLRR

SEQ ID NO: 43711 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKKGVSNKDIEKETAKDAAGEPPSMTQLLRR

SEQ ID NO: 43712 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKKGVSNKDIEKETAKDAASEPPSMTQLLRR

SEQ ID NO: 43713 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKKGVSNKDIEKETAKDAAAEPPSMTQLLRR

SEQ ID NO: 43714 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKNGVSNKDIEKETAKDGGGEPPSMTQLLRR

SEQ ID NO: 43715 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKNGVSNKDIEKETAKDGGSEPPSMTQLLRR

SEQ ID NO: 43716 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKNGVSNKDIEKETAKDGGAEPPSMTQLLRR

SEQ ID NO: 43717 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKNGVSNKDIEKETAKDGSGEPPSMTQLLRR

SEQ ID NO: 43718 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKNGVSNKDIEKETAKDGSSEPPSMTQLLRR

SEQ ID NO: 43719 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKNGVSNKDIEKETAKDGSAEPPSMTQLLRR

SEQ ID NO: 43720 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKNGVSNKDIEKETAKDGAGEPPSMTQLLRR

SEQ ID NO: 43721 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKNGVSNKDIEKETAKDGASEPPSMTQLLRR

SEQ ID NO: 43722 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKNGVSNKDIEKETAKDGAAEPPSMTQLLRR

SEQ ID NO: 43723 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKNGVSNKDIEKETAKDSGGEPPSMTQLLRR

SEQ ID NO: 43724 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKNGVSNKDIEKETAKDSGSEPPSMTQLLRR

SEQ ID NO: 43725 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKNGVSNKDIEKETAKDSGAEPPSMTQLLRR

SEQ ID NO: 43726 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKNGVSNKDIEKETAKDSSGEPPSMTQLLRR

SEQ ID NO: 43727 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKNGVSNKDIEKETAKDSSSEPPSMTQLLRR

SEQ ID NO: 43728 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKNGVSNKDIEKETAKDSSAEPPSMTQLLRR

SEQ ID NO: 43729 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKNGVSNKDIEKETAKDSAGEPPSMTQLLRR

SEQ ID NO: 43730 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKNGVSNKDIEKETAKDSASEPPSMTQLLRR

SEQ ID NO: 43731 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKNGVSNKDIEKETAKDSAAEPPSMTQLLRR

SEQ ID NO: 43732 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKNGVSNKDIEKETAKDAGGEPPSMTQLLRR

SEQ ID NO: 43733 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKNGVSNKDIEKETAKDAGSEPPSMTQLLRR

SEQ ID NO: 43734 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKNGVSNKDIEKETAKDAGAEPPSMTQLLRR

SEQ ID NO: 43735 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKNGVSNKDIEKETAKDASGEPPSMTQLLRR

SEQ ID NO: 43736 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKNGVSNKDIEKETAKDASSEPPSMTQLLRR

SEQ ID NO: 43737 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKNGVSNKDIEKETAKDASAEPPSMTQLLRR

SEQ ID NO: 43738 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKNGVSNKDIEKETAKDAAGEPPSMTQLLRR

SEQ ID NO: 43739 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKNGVSNKDIEKETAKDAASEPPSMTQLLRR

SEQ ID NO: 43740 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKNGVSNKDIEKETAKDAAAEPPSMTQLLRR

SEQ ID NO: 43741 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKMGVSNKDIEKETAKDGGGEPPSMTQLLRR

SEQ ID NO: 43742 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKMGVSNKDIEKETAKDGGSEPPSMTQLLRR

SEQ ID NO: 43743 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKMGVSNKDIEKETAKDGGAEPPSMTQLLRR

SEQ ID NO: 43744 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKMGVSNKDIEKETAKDGSGEPPSMTQLLRR

SEQ ID NO: 43745 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKMGVSNKDIEKETAKDGSSEPPSMTQLLRR

SEQ ID NO: 43746 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKMGVSNKDIEKETAKDGSAEPPSMTQLLRR

SEQ ID NO: 43747 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKMGVSNKDIEKETAKDGAGEPPSMTQLLRR

SEQ ID NO: 43748 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKMGVSNKDIEKETAKDGASEPPSMTQLLRR

SEQ ID NO: 43749 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKMGVSNKDIEKETAKDGAAEPPSMTQLLRR

SEQ ID NO: 43750 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKMGVSNKDIEKETAKDSGGEPPSMTQLLRR

SEQ ID NO: 43751 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKMGVSNKDIEKETAKDSGSEPPSMTQLLRR

SEQ ID NO: 43752 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKMGVSNKDIEKETAKDSGAEPPSMTQLLRR

SEQ ID NO: 43753 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKMGVSNKDIEKETAKDSSGEPPSMTQLLRR

SEQ ID NO: 43754 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKMGVSNKDIEKETAKDSSSEPPSMTQLLRR

SEQ ID NO: 43755 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKMGVSNKDIEKETAKDSSAEPPSMTQLLRR

SEQ ID NO: 43756 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKMGVSNKDIEKETAKDSAGEPPSMTQLLRR

SEQ ID NO: 43757 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKMGVSNKDIEKETAKDSASEPPSMTQLLRR

SEQ ID NO: 43758 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKMGVSNKDIEKETAKDSAAEPPSMTQLLRR

SEQ ID NO: 43759 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKMGVSNKDIEKETAKDAGGEPPSMTQLLRR

SEQ ID NO: 43760 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKMGVSNKDIEKETAKDAGSEPPSMTQLLRR

SEQ ID NO: 43761 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKMGVSNKDIEKETAKDAGAEPPSMTQLLRR

SEQ ID NO: 43762 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKMGVSNKDIEKETAKDASGEPPSMTQLLRR

SEQ ID NO: 43763 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKMGVSNKDIEKETAKDASSEPPSMTQLLRR

SEQ ID NO: 43764 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKMGVSNKDIEKETAKDASAEPPSMTQLLRR

SEQ ID NO: 43765 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKMGVSNKDIEKETAKDAAGEPPSMTQLLRR

SEQ ID NO: 43766 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKMGVSNKDIEKETAKDAASEPPSMTQLLRR

SEQ ID NO: 43767 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKMGVSNKDIEKETAKDAAAEPPSMTQLLRR

SEQ ID NO: 43768 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKCGVSNKDIEKETAKDGGGEPPSMTQLLRR

SEQ ID NO: 43769 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKCGVSNKDIEKETAKDGGSEPPSMTQLLRR

SEQ ID NO: 43770 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKCGVSNKDIEKETAKDGGAEPPSMTQLLRR

SEQ ID NO: 43771 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKCGVSNKDIEKETAKDGSGEPPSMTQLLRR

SEQ ID NO: 43772 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKCGVSNKDIEKETAKDGSSEPPSMTQLLRR

SEQ ID NO: 43773 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKCGVSNKDIEKETAKDGSAEPPSMTQLLRR

SEQ ID NO: 43774 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKCGVSNKDIEKETAKDGAGEPPSMTQLLRR

SEQ ID NO: 43775 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKCGVSNKDIEKETAKDGASEPPSMTQLLRR

SEQ ID NO: 43776 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKCGVSNKDIEKETAKDGAAEPPSMTQLLRR

SEQ ID NO: 43777 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKCGVSNKDIEKETAKDSGGEPPSMTQLLRR

SEQ ID NO: 43778 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKCGVSNKDIEKETAKDSGSEPPSMTQLLRR

SEQ ID NO: 43779 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKCGVSNKDIEKETAKDSGAEPPSMTQLLRR

SEQ ID NO: 43780 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKCGVSNKDIEKETAKDSSGEPPSMTQLLRR

SEQ ID NO: 43781 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKCGVSNKDIEKETAKDSSSEPPSMTQLLRR

SEQ ID NO: 43782 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKCGVSNKDIEKETAKDSSAEPPSMTQLLRR

SEQ ID NO: 43783 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKCGVSNKDIEKETAKDSAGEPPSMTQLLRR

SEQ ID NO: 43784 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKCGVSNKDIEKETAKDSASEPPSMTQLLRR

SEQ ID NO: 43785 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKCGVSNKDIEKETAKDSAAEPPSMTQLLRR

SEQ ID NO: 43786 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKCGVSNKDIEKETAKDAGGEPPSMTQLLRR

SEQ ID NO: 43787 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKCGVSNKDIEKETAKDAGSEPPSMTQLLRR

SEQ ID NO: 43788 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKCGVSNKDIEKETAKDAGAEPPSMTQLLRR

SEQ ID NO: 43789 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKCGVSNKDIEKETAKDASGEPPSMTQLLRR

SEQ ID NO: 43790 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKCGVSNKDIEKETAKDASSEPPSMTQLLRR

SEQ ID NO: 43791 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKCGVSNKDIEKETAKDASAEPPSMTQLLRR

SEQ ID NO: 43792 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKCGVSNKDIEKETAKDAAGEPPSMTQLLRR

SEQ ID NO: 43793 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKCGVSNKDIEKETAKDAASEPPSMTQLLRR

SEQ ID NO: 43794 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKCGVSNKDIEKETAKDAAAEPPSMTQLLRR

SEQ ID NO: 43795 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKSGVSNKDIEKETAKDGGGEPPSMTQLLRR

SEQ ID NO: 43796 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKSGVSNKDIEKETAKDGGSEPPSMTQLLRR

SEQ ID NO: 43797 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKSGVSNKDIEKETAKDGGAEPPSMTQLLRR

SEQ ID NO: 43798 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKSGVSNKDIEKETAKDGSGEPPSMTQLLRR

SEQ ID NO: 43799 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKSGVSNKDIEKETAKDGSSEPPSMTQLLRR

SEQ ID NO: 43800 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKSGVSNKDIEKETAKDGSAEPPSMTQLLRR

SEQ ID NO: 43801 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKSGVSNKDIEKETAKDGAGEPPSMTQLLRR

SEQ ID NO: 43802 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKSGVSNKDIEKETAKDGASEPPSMTQLLRR

SEQ ID NO: 43803 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKSGVSNKDIEKETAKDGAAEPPSMTQLLRR

SEQ ID NO: 43804 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKSGVSNKDIEKETAKDSGGEPPSMTQLLRR

SEQ ID NO: 43805 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKSGVSNKDIEKETAKDSGSEPPSMTQLLRR

SEQ ID NO: 43806 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKSGVSNKDIEKETAKDSGAEPPSMTQLLRR

SEQ ID NO: 43807 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKSGVSNKDIEKETAKDSSGEPPSMTQLLRR

SEQ ID NO: 43808 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKSGVSNKDIEKETAKDSSSEPPSMTQLLRR

SEQ ID NO: 43809 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKSGVSNKDIEKETAKDSSAEPPSMTQLLRR

SEQ ID NO: 43810 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKSGVSNKDIEKETAKDSAGEPPSMTQLLRR

SEQ ID NO: 43811 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKSGVSNKDIEKETAKDSASEPPSMTQLLRR

SEQ ID NO: 43812 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKSGVSNKDIEKETAKDSAAEPPSMTQLLRR

SEQ ID NO: 43813 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKSGVSNKDIEKETAKDAGGEPPSMTQLLRR

SEQ ID NO: 43814 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKSGVSNKDIEKETAKDAGSEPPSMTQLLRR

SEQ ID NO: 43815 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKSGVSNKDIEKETAKDAGAEPPSMTQLLRR

SEQ ID NO: 43816 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKSGVSNKDIEKETAKDASGEPPSMTQLLRR

SEQ ID NO: 43817 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKSGVSNKDIEKETAKDASSEPPSMTQLLRR

SEQ ID NO: 43818 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKSGVSNKDIEKETAKDASAEPPSMTQLLRR

SEQ ID NO: 43819 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKSGVSNKDIEKETAKDAAGEPPSMTQLLRR

SEQ ID NO: 43820 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKSGVSNKDIEKETAKDAASEPPSMTQLLRR

SEQ ID NO: 43821 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKSGVSNKDIEKETAKDAAAEPPSMTQLLRR

SEQ ID NO: 43822 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKAGVSNKDIEKETAKDGGGEPPSMTQLLRR

SEQ ID NO: 43823 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKAGVSNKDIEKETAKDGGSEPPSMTQLLRR

SEQ ID NO: 43824 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKAGVSNKDIEKETAKDGGAEPPSMTQLLRR

SEQ ID NO: 43825 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKAGVSNKDIEKETAKDGSGEPPSMTQLLRR

SEQ ID NO: 43826 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKAGVSNKDIEKETAKDGSSEPPSMTQLLRR

SEQ ID NO: 43827 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKAGVSNKDIEKETAKDGSAEPPSMTQLLRR

SEQ ID NO: 43828 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKAGVSNKDIEKETAKDGAGEPPSMTQLLRR

SEQ ID NO: 43829 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKAGVSNKDIEKETAKDGASEPPSMTQLLRR

SEQ ID NO: 43830 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKAGVSNKDIEKETAKDGAAEPPSMTQLLRR

SEQ ID NO: 43831 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKAGVSNKDIEKETAKDSGGEPPSMTQLLRR

SEQ ID NO: 43832 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKAGVSNKDIEKETAKDSGSEPPSMTQLLRR

SEQ ID NO: 43833 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKAGVSNKDIEKETAKDSGAEPPSMTQLLRR

SEQ ID NO: 43834 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKAGVSNKDIEKETAKDSSGEPPSMTQLLRR

SEQ ID NO: 43835 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKAGVSNKDIEKETAKDSSSEPPSMTQLLRR

SEQ ID NO: 43836 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKAGVSNKDIEKETAKDSSAEPPSMTQLLRR

SEQ ID NO: 43837 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKAGVSNKDIEKETAKDSAGEPPSMTQLLRR

SEQ ID NO: 43838 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKAGVSNKDIEKETAKDSASEPPSMTQLLRR

SEQ ID NO: 43839 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKAGVSNKDIEKETAKDSAAEPPSMTQLLRR

SEQ ID NO: 43840 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKAGVSNKDIEKETAKDAGGEPPSMTQLLRR

SEQ ID NO: 43841 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKAGVSNKDIEKETAKDAGSEPPSMTQLLRR

SEQ ID NO: 43842 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKAGVSNKDIEKETAKDAGAEPPSMTQLLRR

SEQ ID NO: 43843 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKAGVSNKDIEKETAKDASGEPPSMTQLLRR

SEQ ID NO: 43844 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKAGVSNKDIEKETAKDASSEPPSMTQLLRR

SEQ ID NO: 43845 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKAGVSNKDIEKETAKDASAEPPSMTQLLRR

SEQ ID NO: 43846 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKAGVSNKDIEKETAKDAAGEPPSMTQLLRR

SEQ ID NO: 43847 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKAGVSNKDIEKETAKDAASEPPSMTQLLRR

SEQ ID NO: 43848 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKAGVSNKDIEKETAKDAAAEPPSMTQLLRR

SEQ ID NO: 43849 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKGGVSNKDIEKETAKDGGGEPPSMTQLLRR

SEQ ID NO: 43850 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKGGVSNKDIEKETAKDGGSEPPSMTQLLRR

SEQ ID NO: 43851 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKGGVSNKDIEKETAKDGGAEPPSMTQLLRR

SEQ ID NO: 43852 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKGGVSNKDIEKETAKDGSGEPPSMTQLLRR

SEQ ID NO: 43853 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKGGVSNKDIEKETAKDGSSEPPSMTQLLRR

SEQ ID NO: 43854 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKGGVSNKDIEKETAKDGSAEPPSMTQLLRR

SEQ ID NO: 43855 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKGGVSNKDIEKETAKDGAGEPPSMTQLLRR

SEQ ID NO: 43856 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKGGVSNKDIEKETAKDGASEPPSMTQLLRR

SEQ ID NO: 43857 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKGGVSNKDIEKETAKDGAAEPPSMTQLLRR

SEQ ID NO: 43858 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKGGVSNKDIEKETAKDSGGEPPSMTQLLRR

SEQ ID NO: 43859 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKGGVSNKDIEKETAKDSGSEPPSMTQLLRR

SEQ ID NO: 43860 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKGGVSNKDIEKETAKDSGAEPPSMTQLLRR

SEQ ID NO: 43861 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKGGVSNKDIEKETAKDSSGEPPSMTQLLRR

SEQ ID NO: 43862 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKGGVSNKDIEKETAKDSSSEPPSMTQLLRR

SEQ ID NO: 43863 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKGGVSNKDIEKETAKDSSAEPPSMTQLLRR

SEQ ID NO: 43864 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKGGVSNKDIEKETAKDSAGEPPSMTQLLRR

SEQ ID NO: 43865 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKGGVSNKDIEKETAKDSASEPPSMTQLLRR

SEQ ID NO: 43866 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKGGVSNKDIEKETAKDSAAEPPSMTQLLRR

SEQ ID NO: 43867 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKGGVSNKDIEKETAKDAGGEPPSMTQLLRR

SEQ ID NO: 43868 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKGGVSNKDIEKETAKDAGSEPPSMTQLLRR

SEQ ID NO: 43869 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKGGVSNKDIEKETAKDAGAEPPSMTQLLRR

SEQ ID NO: 43870 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKGGVSNKDIEKETAKDASGEPPSMTQLLRR

SEQ ID NO: 43871 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKGGVSNKDIEKETAKDASSEPPSMTQLLRR

SEQ ID NO: 43872 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKGGVSNKDIEKETAKDASAEPPSMTQLLRR

SEQ ID NO: 43873 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKGGVSNKDIEKETAKDAAGEPPSMTQLLRR

SEQ ID NO: 43874 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKGGVSNKDIEKETAKDAASEPPSMTQLLRR

SEQ ID NO: 43875 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKGGVSNKDIEKETAKDAAAEPPSMTQLLRR

SEQ ID NO: 43876 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKDGVSNKDIEKETAKDGGGEPPSMTQLLRR

SEQ ID NO: 43877 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKDGVSNKDIEKETAKDGGSEPPSMTQLLRR

SEQ ID NO: 43878 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKDGVSNKDIEKETAKDGGAEPPSMTQLLRR

SEQ ID NO: 43879 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKDGVSNKDIEKETAKDGSGEPPSMTQLLRR

SEQ ID NO: 43880 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKDGVSNKDIEKETAKDGSSEPPSMTQLLRR

SEQ ID NO: 43881 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKDGVSNKDIEKETAKDGSAEPPSMTQLLRR

SEQ ID NO: 43882 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKDGVSNKDIEKETAKDGAGEPPSMTQLLRR

SEQ ID NO: 43883 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKDGVSNKDIEKETAKDGASEPPSMTQLLRR

SEQ ID NO: 43884 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKDGVSNKDIEKETAKDGAAEPPSMTQLLRR

SEQ ID NO: 43885 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKDGVSNKDIEKETAKDSGGEPPSMTQLLRR

SEQ ID NO: 43886 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKDGVSNKDIEKETAKDSGSEPPSMTQLLRR

SEQ ID NO: 43887 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKDGVSNKDIEKETAKDSGAEPPSMTQLLRR

SEQ ID NO: 43888 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKDGVSNKDIEKETAKDSSGEPPSMTQLLRR

SEQ ID NO: 43889 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKDGVSNKDIEKETAKDSSSEPPSMTQLLRR

SEQ ID NO: 43890 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKDGVSNKDIEKETAKDSSAEPPSMTQLLRR

SEQ ID NO: 43891 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKDGVSNKDIEKETAKDSAGEPPSMTQLLRR

SEQ ID NO: 43892 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKDGVSNKDIEKETAKDSASEPPSMTQLLRR

SEQ ID NO: 43893 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKDGVSNKDIEKETAKDSAAEPPSMTQLLRR

SEQ ID NO: 43894 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKDGVSNKDIEKETAKDAGGEPPSMTQLLRR

SEQ ID NO: 43895 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKDGVSNKDIEKETAKDAGSEPPSMTQLLRR

SEQ ID NO: 43896 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKDGVSNKDIEKETAKDAGAEPPSMTQLLRR

SEQ ID NO: 43897 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKDGVSNKDIEKETAKDASGEPPSMTQLLRR

SEQ ID NO: 43898 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKDGVSNKDIEKETAKDASSEPPSMTQLLRR

SEQ ID NO: 43899 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKDGVSNKDIEKETAKDASAEPPSMTQLLRR

SEQ ID NO: 43900 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKDGVSNKDIEKETAKDAAGEPPSMTQLLRR

SEQ ID NO: 43901 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKDGVSNKDIEKETAKDAASEPPSMTQLLRR

SEQ ID NO: 43902 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKDGVSNKDIEKETAKDAAAEPPSMTQLLRR

SEQ ID NO: 43903 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKHGVSNKDIEKETAKDGGGEPPSMTQLLRR

SEQ ID NO: 43904 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKHGVSNKDIEKETAKDGGSEPPSMTQLLRR

SEQ ID NO: 43905 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKHGVSNKDIEKETAKDGGAEPPSMTQLLRR

SEQ ID NO: 43906 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKHGVSNKDIEKETAKDGSGEPPSMTQLLRR

SEQ ID NO: 43907 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKHGVSNKDIEKETAKDGSSEPPSMTQLLRR

SEQ ID NO: 43908 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKHGVSNKDIEKETAKDGSAEPPSMTQLLRR

SEQ ID NO: 43909 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKHGVSNKDIEKETAKDGAGEPPSMTQLLRR

SEQ ID NO: 43910 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKHGVSNKDIEKETAKDGASEPPSMTQLLRR

SEQ ID NO: 43911 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKHGVSNKDIEKETAKDGAAEPPSMTQLLRR

SEQ ID NO: 43912 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKHGVSNKDIEKETAKDSGGEPPSMTQLLRR

SEQ ID NO: 43913 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKHGVSNKDIEKETAKDSGSEPPSMTQLLRR

SEQ ID NO: 43914 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKHGVSNKDIEKETAKDSGAEPPSMTQLLRR

SEQ ID NO: 43915 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKHGVSNKDIEKETAKDSSGEPPSMTQLLRR

SEQ ID NO: 43916 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKHGVSNKDIEKETAKDSSSEPPSMTQLLRR

SEQ ID NO: 43917 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKHGVSNKDIEKETAKDSSAEPPSMTQLLRR

SEQ ID NO: 43918 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKHGVSNKDIEKETAKDSAGEPPSMTQLLRR

SEQ ID NO: 43919 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKHGVSNKDIEKETAKDSASEPPSMTQLLRR

SEQ ID NO: 43920 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKHGVSNKDIEKETAKDSAAEPPSMTQLLRR

SEQ ID NO: 43921 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKHGVSNKDIEKETAKDAGGEPPSMTQLLRR

SEQ ID NO: 43922 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKHGVSNKDIEKETAKDAGSEPPSMTQLLRR

SEQ ID NO: 43923 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKHGVSNKDIEKETAKDAGAEPPSMTQLLRR

SEQ ID NO: 43924 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKHGVSNKDIEKETAKDASGEPPSMTQLLRR

SEQ ID NO: 43925 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKHGVSNKDIEKETAKDASSEPPSMTQLLRR

SEQ ID NO: 43926 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKHGVSNKDIEKETAKDASAEPPSMTQLLRR

SEQ ID NO: 43927 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKHGVSNKDIEKETAKDAAGEPPSMTQLLRR

SEQ ID NO: 43928 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKHGVSNKDIEKETAKDAASEPPSMTQLLRR

SEQ ID NO: 43929 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKHGVSNKDIEKETAKDAAAEPPSMTQLLRR

SEQ ID NO: 43930 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKYGVSNKDIEKETAKDGGGEPPSMTQLLRR

SEQ ID NO: 43931 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKYGVSNKDIEKETAKDGGSEPPSMTQLLRR

SEQ ID NO: 43932 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKYGVSNKDIEKETAKDGGAEPPSMTQLLRR

SEQ ID NO: 43933 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKYGVSNKDIEKETAKDGSGEPPSMTQLLRR

SEQ ID NO: 43934 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKYGVSNKDIEKETAKDGSSEPPSMTQLLRR

SEQ ID NO: 43935 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKYGVSNKDIEKETAKDGSAEPPSMTQLLRR

SEQ ID NO: 43936 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKYGVSNKDIEKETAKDGAGEPPSMTQLLRR

SEQ ID NO: 43937 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKYGVSNKDIEKETAKDGASEPPSMTQLLRR

SEQ ID NO: 43938 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKYGVSNKDIEKETAKDGAAEPPSMTQLLRR

SEQ ID NO: 43939 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKYGVSNKDIEKETAKDSGGEPPSMTQLLRR

SEQ ID NO: 43940 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKYGVSNKDIEKETAKDSGSEPPSMTQLLRR

SEQ ID NO: 43941 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKYGVSNKDIEKETAKDSGAEPPSMTQLLRR

SEQ ID NO: 43942 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKYGVSNKDIEKETAKDSSGEPPSMTQLLRR

SEQ ID NO: 43943 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKYGVSNKDIEKETAKDSSSEPPSMTQLLRR

SEQ ID NO: 43944 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKYGVSNKDIEKETAKDSSAEPPSMTQLLRR

SEQ ID NO: 43945 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKYGVSNKDIEKETAKDSAGEPPSMTQLLRR

SEQ ID NO: 43946 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKYGVSNKDIEKETAKDSASEPPSMTQLLRR

SEQ ID NO: 43947 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKYGVSNKDIEKETAKDSAAEPPSMTQLLRR

SEQ ID NO: 43948 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKYGVSNKDIEKETAKDAGGEPPSMTQLLRR

SEQ ID NO: 43949 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKYGVSNKDIEKETAKDAGSEPPSMTQLLRR

SEQ ID NO: 43950 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKYGVSNKDIEKETAKDAGAEPPSMTQLLRR

SEQ ID NO: 43951 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKYGVSNKDIEKETAKDASGEPPSMTQLLRR

SEQ ID NO: 43952 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKYGVSNKDIEKETAKDASSEPPSMTQLLRR

SEQ ID NO: 43953 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKYGVSNKDIEKETAKDASAEPPSMTQLLRR

SEQ ID NO: 43954 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKYGVSNKDIEKETAKDAAGEPPSMTQLLRR

SEQ ID NO: 43955 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKYGVSNKDIEKETAKDAASEPPSMTQLLRR

SEQ ID NO: 43956 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKYGVSNKDIEKETAKDAAAEPPSMTQLLRR

SEQ ID NO: 43957 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKKGVSNKDIEKETAKDGGGEPPSMTQLLRR

SEQ ID NO: 43958 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKKGVSNKDIEKETAKDGGSEPPSMTQLLRR

SEQ ID NO: 43959 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKKGVSNKDIEKETAKDGGAEPPSMTQLLRR

SEQ ID NO: 43960 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKKGVSNKDIEKETAKDGSGEPPSMTQLLRR

SEQ ID NO: 43961 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKKGVSNKDIEKETAKDGSSEPPSMTQLLRR

SEQ ID NO: 43962 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKKGVSNKDIEKETAKDGSAEPPSMTQLLRR

SEQ ID NO: 43963 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKKGVSNKDIEKETAKDGAGEPPSMTQLLRR

SEQ ID NO: 43964 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKKGVSNKDIEKETAKDGASEPPSMTQLLRR

SEQ ID NO: 43965 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKKGVSNKDIEKETAKDGAAEPPSMTQLLRR

SEQ ID NO: 43966 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKKGVSNKDIEKETAKDSGGEPPSMTQLLRR

SEQ ID NO: 43967 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKKGVSNKDIEKETAKDSGSEPPSMTQLLRR

SEQ ID NO: 43968 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKKGVSNKDIEKETAKDSGAEPPSMTQLLRR

SEQ ID NO: 43969 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKKGVSNKDIEKETAKDSSGEPPSMTQLLRR

SEQ ID NO: 43970 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKKGVSNKDIEKETAKDSSSEPPSMTQLLRR

SEQ ID NO: 43971 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKKGVSNKDIEKETAKDSSAEPPSMTQLLRR

SEQ ID NO: 43972 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKKGVSNKDIEKETAKDSAGEPPSMTQLLRR

SEQ ID NO: 43973 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKKGVSNKDIEKETAKDSASEPPSMTQLLRR

SEQ ID NO: 43974 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKKGVSNKDIEKETAKDSAAEPPSMTQLLRR

SEQ ID NO: 43975 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKKGVSNKDIEKETAKDAGGEPPSMTQLLRR

SEQ ID NO: 43976 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKKGVSNKDIEKETAKDAGSEPPSMTQLLRR

SEQ ID NO: 43977 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKKGVSNKDIEKETAKDAGAEPPSMTQLLRR

SEQ ID NO: 43978 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKKGVSNKDIEKETAKDASGEPPSMTQLLRR

SEQ ID NO: 43979 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKKGVSNKDIEKETAKDASSEPPSMTQLLRR

SEQ ID NO: 43980 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKKGVSNKDIEKETAKDASAEPPSMTQLLRR

SEQ ID NO: 43981 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKKGVSNKDIEKETAKDAAGEPPSMTQLLRR

SEQ ID NO: 43982 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKKGVSNKDIEKETAKDAASEPPSMTQLLRR

SEQ ID NO: 43983 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKKGVSNKDIEKETAKDAAAEPPSMTQLLRR

SEQ ID NO: 43984 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKNGVSNKDIEKETAKDGGGEPPSMTQLLRR

SEQ ID NO: 43985 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKNGVSNKDIEKETAKDGGSEPPSMTQLLRR

SEQ ID NO: 43986 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKNGVSNKDIEKETAKDGGAEPPSMTQLLRR

SEQ ID NO: 43987 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKNGVSNKDIEKETAKDGSGEPPSMTQLLRR

SEQ ID NO: 43988 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKNGVSNKDIEKETAKDGSSEPPSMTQLLRR

SEQ ID NO: 43989 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKNGVSNKDIEKETAKDGSAEPPSMTQLLRR

SEQ ID NO: 43990 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKNGVSNKDIEKETAKDGAGEPPSMTQLLRR

SEQ ID NO: 43991 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKNGVSNKDIEKETAKDGASEPPSMTQLLRR

SEQ ID NO: 43992 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKNGVSNKDIEKETAKDGAAEPPSMTQLLRR

SEQ ID NO: 43993 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKNGVSNKDIEKETAKDSGGEPPSMTQLLRR

SEQ ID NO: 43994 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKNGVSNKDIEKETAKDSGSEPPSMTQLLRR

SEQ ID NO: 43995 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKNGVSNKDIEKETAKDSGAEPPSMTQLLRR

SEQ ID NO: 43996 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKNGVSNKDIEKETAKDSSGEPPSMTQLLRR

SEQ ID NO: 43997 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKNGVSNKDIEKETAKDSSSEPPSMTQLLRR

SEQ ID NO: 43998 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKNGVSNKDIEKETAKDSSAEPPSMTQLLRR

SEQ ID NO: 43999 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKNGVSNKDIEKETAKDSAGEPPSMTQLLRR

SEQ ID NO: 44000 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKNGVSNKDIEKETAKDSASEPPSMTQLLRR

SEQ ID NO: 44001 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKNGVSNKDIEKETAKDSAAEPPSMTQLLRR

SEQ ID NO: 44002 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKNGVSNKDIEKETAKDAGGEPPSMTQLLRR

SEQ ID NO: 44003 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKNGVSNKDIEKETAKDAGSEPPSMTQLLRR

SEQ ID NO: 44004 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKNGVSNKDIEKETAKDAGAEPPSMTQLLRR

SEQ ID NO: 44005 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKNGVSNKDIEKETAKDASGEPPSMTQLLRR

SEQ ID NO: 44006 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKNGVSNKDIEKETAKDASSEPPSMTQLLRR

SEQ ID NO: 44007 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKNGVSNKDIEKETAKDASAEPPSMTQLLRR

SEQ ID NO: 44008 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKNGVSNKDIEKETAKDAAGEPPSMTQLLRR

SEQ ID NO: 44009 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKNGVSNKDIEKETAKDAASEPPSMTQLLRR

SEQ ID NO: 44010 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKNGVSNKDIEKETAKDAAAEPPSMTQLLRR

SEQ ID NO: 44011 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKMGVSNKDIEKETAKDGGGEPPSMTQLLRR

SEQ ID NO: 44012 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKMGVSNKDIEKETAKDGGSEPPSMTQLLRR

SEQ ID NO: 44013 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKMGVSNKDIEKETAKDGGAEPPSMTQLLRR

SEQ ID NO: 44014 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKMGVSNKDIEKETAKDGSGEPPSMTQLLRR

SEQ ID NO: 44015 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKMGVSNKDIEKETAKDGSSEPPSMTQLLRR

SEQ ID NO: 44016 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKMGVSNKDIEKETAKDGSAEPPSMTQLLRR

SEQ ID NO: 44017 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKMGVSNKDIEKETAKDGAGEPPSMTQLLRR

SEQ ID NO: 44018 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKMGVSNKDIEKETAKDGASEPPSMTQLLRR

SEQ ID NO: 44019 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKMGVSNKDIEKETAKDGAAEPPSMTQLLRR

SEQ ID NO: 44020 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKMGVSNKDIEKETAKDSGGEPPSMTQLLRR

SEQ ID NO: 44021 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKMGVSNKDIEKETAKDSGSEPPSMTQLLRR

SEQ ID NO: 44022 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKMGVSNKDIEKETAKDSGAEPPSMTQLLRR

SEQ ID NO: 44023 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKMGVSNKDIEKETAKDSSGEPPSMTQLLRR

SEQ ID NO: 44024 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKMGVSNKDIEKETAKDSSSEPPSMTQLLRR

SEQ ID NO: 44025 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKMGVSNKDIEKETAKDSSAEPPSMTQLLRR

SEQ ID NO: 44026 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKMGVSNKDIEKETAKDSAGEPPSMTQLLRR

SEQ ID NO: 44027 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKMGVSNKDIEKETAKDSASEPPSMTQLLRR

SEQ ID NO: 44028 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKMGVSNKDIEKETAKDSAAEPPSMTQLLRR

SEQ ID NO: 44029 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKMGVSNKDIEKETAKDAGGEPPSMTQLLRR

SEQ ID NO: 44030 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKMGVSNKDIEKETAKDAGSEPPSMTQLLRR

SEQ ID NO: 44031 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKMGVSNKDIEKETAKDAGAEPPSMTQLLRR

SEQ ID NO: 44032 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKMGVSNKDIEKETAKDASGEPPSMTQLLRR

SEQ ID NO: 44033 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKMGVSNKDIEKETAKDASSEPPSMTQLLRR

SEQ ID NO: 44034 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKMGVSNKDIEKETAKDASAEPPSMTQLLRR

SEQ ID NO: 44035 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKMGVSNKDIEKETAKDAAGEPPSMTQLLRR

SEQ ID NO: 44036 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKMGVSNKDIEKETAKDAASEPPSMTQLLRR

SEQ ID NO: 44037 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKMGVSNKDIEKETAKDAAAEPPSMTQLLRR

SEQ ID NO: 44038 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDGFGLRGLLHLENASYGIEPLQNSSHFEHIIYRMDDVYKEPLKCGVSNKDIEKETAKDGGGEPPSMTQLLRR

SEQ ID NO: 44039 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDGFGLRGLLHLENASYGIEPLQNSSHFEHIIYRMDDVYKEPLKCGVSNKDIEKETAKDGGSEPPSMTQLLRR

SEQ ID NO: 44040 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDGFGLRGLLHLENASYGIEPLQNSSHFEHIIYRMDDVYKEPLKCGVSNKDIEKETAKDGGAEPPSMTQLLRR

SEQ ID NO: 44041 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDGFGLRGLLHLENASYGIEPLQNSSHFEHIIYRMDDVYKEPLKCGVSNKDIEKETAKDGSGEPPSMTQLLRR

SEQ ID NO: 44042 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDGFGLRGLLHLENASYGIEPLQNSSHFEHIIYRMDDVYKEPLKCGVSNKDIEKETAKDGSSEPPSMTQLLRR

SEQ ID NO: 44043 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDGFGLRGLLHLENASYGIEPLQNSSHFEHIIYRMDDVYKEPLKCGVSNKDIEKETAKDGSAEPPSMTQLLRR

SEQ ID NO: 44044 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDGFGLRGLLHLENASYGIEPLQNSSHFEHIIYRMDDVYKEPLKCGVSNKDIEKETAKDGAGEPPSMTQLLRR

SEQ ID NO: 44045 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDGFGLRGLLHLENASYGIEPLQNSSHFEHIIYRMDDVYKEPLKCGVSNKDIEKETAKDGASEPPSMTQLLRR

SEQ ID NO: 44046 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDGFGLRGLLHLENASYGIEPLQNSSHFEHIIYRMDDVYKEPLKCGVSNKDIEKETAKDGAAEPPSMTQLLRR

SEQ ID NO: 44047 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDGFGLRGLLHLENASYGIEPLQNSSHFEHIIYRMDDVYKEPLKCGVSNKDIEKETAKDSGGEPPSMTQLLRR

SEQ ID NO: 44048 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDGFGLRGLLHLENASYGIEPLQNSSHFEHIIYRMDDVYKEPLKCGVSNKDIEKETAKDSGSEPPSMTQLLRR

SEQ ID NO: 44049 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDGFGLRGLLHLENASYGIEPLQNSSHFEHIIYRMDDVYKEPLKCGVSNKDIEKETAKDSGAEPPSMTQLLRR

SEQ ID NO: 44050 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDGFGLRGLLHLENASYGIEPLQNSSHFEHIIYRMDDVYKEPLKCGVSNKDIEKETAKDSSGEPPSMTQLLRR

SEQ ID NO: 44051 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDGFGLRGLLHLENASYGIEPLQNSSHFEHIIYRMDDVYKEPLKCGVSNKDIEKETAKDSSSEPPSMTQLLRR

SEQ ID NO: 44052 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDGFGLRGLLHLENASYGIEPLQNSSHFEHIIYRMDDVYKEPLKCGVSNKDIEKETAKDSSAEPPSMTQLLRR

SEQ ID NO: 44053 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDGFGLRGLLHLENASYGIEPLQNSSHFEHIIYRMDDVYKEPLKCGVSNKDIEKETAKDSAGEPPSMTQLLRR

SEQ ID NO: 44054 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDGFGLRGLLHLENASYGIEPLQNSSHFEHIIYRMDDVYKEPLKCGVSNKDIEKETAKDSASEPPSMTQLLRR

SEQ ID NO: 44055 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDGFGLRGLLHLENASYGIEPLQNSSHFEHIIYRMDDVYKEPLKCGVSNKDIEKETAKDSAAEPPSMTQLLRR

SEQ ID NO: 44056 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDGFGLRGLLHLENASYGIEPLQNSSHFEHIIYRMDDVYKEPLKCGVSNKDIEKETAKDAGGEPPSMTQLLRR

SEQ ID NO: 44057 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDGFGLRGLLHLENASYGIEPLQNSSHFEHIIYRMDDVYKEPLKCGVSNKDIEKETAKDAGSEPPSMTQLLRR

SEQ ID NO: 44058 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDGFGLRGLLHLENASYGIEPLQNSSHFEHIIYRMDDVYKEPLKCGVSNKDIEKETAKDAGAEPPSMTQLLRR

SEQ ID NO: 44059 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDGFGLRGLLHLENASYGIEPLQNSSHFEHIIYRMDDVYKEPLKCGVSNKDIEKETAKDASGEPPSMTQLLRR

SEQ ID NO: 44060 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDGFGLRGLLHLENASYGIEPLQNSSHFEHIIYRMDDVYKEPLKCGVSNKDIEKETAKDASSEPPSMTQLLRR

SEQ ID NO: 44061 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDGFGLRGLLHLENASYGIEPLQNSSHFEHIIYRMDDVYKEPLKCGVSNKDIEKETAKDASAEPPSMTQLLRR

SEQ ID NO: 44062 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHYHYRGYVEGVHNSSIALSDGFGLRGLLHLENASYGIEPLQNSSHFEHIIYRMDDVYKEPLKCGVSNKDIEKETAKDAAGEPPSMTQLLRR
